US012215156B2

(12) United States Patent
Schellenberger et al.

(10) Patent No.: US 12,215,156 B2
(45) Date of Patent: Feb. 4, 2025

(54) HER-2 TARGETED BISPECIFIC COMPOSITIONS AND METHODS FOR MAKING AND USING THE SAME

(71) Applicant: AMUNIX PHARMACEUTICALS, INC., South San Francisco, CA (US)

(72) Inventors: Volker Schellenberger, Palo Alto, CA (US); Eric Johansen, Oakland, CA (US); Angela Henkensiefken, San Jose, CA (US); Darragh Maccann, Magherfelt (GB); James McClory, Banbridge (GB); Philipp Kuhn, Breman (DE); Andre Frenzel, Braunschweig (DE); Bryan Irving, Woodside, CA (US); Mika Derynck, South San Francisco, CA (US)

(73) Assignee: Amunix Pharmaceuticals, Inc., South San Francisco, CA (US)

( * ) Notice: Subject to any disclaimer, the term of this patent is extended or adjusted under 35 U.S.C. 154(b) by 0 days.

(21) Appl. No.: 18/494,007

(22) Filed: Oct. 25, 2023

(65) Prior Publication Data

US 2024/0076378 A1 Mar. 7, 2024

Related U.S. Application Data

(63) Continuation of application No. 18/064,253, filed on Dec. 10, 2022, which is a continuation of application No. PCT/US2021/039006, filed on Jun. 24, 2021.

(60) Provisional application No. 63/196,408, filed on Jun. 3, 2021, provisional application No. 63/166,857, filed on Mar. 26, 2021, provisional application No. 63/108,783, filed on Nov. 2, 2020, provisional application No. 63/077,503, filed on Sep. 11, 2020, provisional application No. 63/044,301, filed on Jun. 25, 2020.

(51) Int. Cl.
| | | |
|---|---|---|
| *C07K 16/28* | (2006.01) | |
| *A61P 35/00* | (2006.01) | |
| *C07K 16/32* | (2006.01) | |
| *C12N 15/70* | (2006.01) | |

(52) U.S. Cl.
CPC .......... *C07K 16/2809* (2013.01); *A61P 35/00* (2018.01); *C07K 16/2818* (2013.01); *C07K 16/2827* (2013.01); *C07K 16/32* (2013.01); *C12N 15/70* (2013.01); *C07K 2317/31* (2013.01); *C07K 2319/30* (2013.01); *C12N 2800/101* (2013.01)

(58) Field of Classification Search
CPC ............... C07K 2319/50; C07K 16/32; C07K 16/2809; C07K 2319/00; C07K 2319/33
See application file for complete search history.

(56) References Cited

U.S. PATENT DOCUMENTS

| | | |
|---|---|---|
| 3,992,518 A | 11/1976 | Chien et al. |
| 4,088,864 A | 5/1978 | Theeuwes et al. |
| 4,200,098 A | 4/1980 | Ayer et al. |
| 4,284,444 A | 8/1981 | Bernstein et al. |
| 4,398,908 A | 8/1983 | Siposs et al. |
| 4,435,173 A | 3/1984 | Siposs et al. |
| 4,684,479 A | 8/1987 | D'Arrigo et al. |
| 4,861,800 A | 8/1989 | Buyske et al. |
| 4,933,185 A | 6/1990 | Wheatley et al. |
| 4,976,696 A | 12/1990 | Sanderson et al. |
| 4,988,337 A | 1/1991 | Ito |
| 5,017,378 A | 5/1991 | Turner et al. |
| 5,176,502 A | 1/1993 | Sanderson et al. |
| 5,186,938 A | 2/1993 | Sablotsky et al. |
| 5,215,680 A | 6/1993 | D'Arrigo et al. |
| 5,298,022 A | 3/1994 | Bernardi |
| 5,318,540 A | 6/1994 | Athayde et al. |
| 5,364,934 A | 11/1994 | Drayna et al. |
| 5,492,534 A | 2/1996 | Athayde et al. |
| 5,573,776 A | 11/1996 | Harrison et al. |
| 5,660,848 A | 8/1997 | Moo-Young et al. |
| 5,756,115 A | 5/1998 | Moo-Young et al. |
| 5,821,337 A | 10/1998 | Carter et al. |
| 5,874,104 A | 2/1999 | Adler-Moore et al. |
| 5,885,573 A | 3/1999 | Bluestone et al. |
| 5,916,588 A | 6/1999 | Popescu et al. |
| 5,965,156 A | 10/1999 | Proffitt et al. |
| 6,043,094 A | 3/2000 | Martin et al. |

(Continued)

FOREIGN PATENT DOCUMENTS

| | | |
|---|---|---|
| WO | WO 1989/009051 A1 | 10/1989 |
| WO | WO 1998/052976 A1 | 11/1998 |

(Continued)

OTHER PUBLICATIONS

Yan et al (Cancer Metastasis Research, 2015, vol. 34, pp. 157-164) (Year: 2015).*

(Continued)

*Primary Examiner* — Karen A. Canella

(74) *Attorney, Agent, or Firm* — Sheppard Mullin Richter & Hampton LLP

(57) ABSTRACT

Disclosed herein are polypeptides, and methods of making and using such polypeptides, that comprise a bispecific antibody construct covalently linked to an extended recombinant polypeptide comprising a barcode fragment releasable from said polypeptide upon digestion by a protease, and a Release Segment that can be proteolytically cleaved wherein said cleavage releases the bispecific antibody construct from the extended recombinant polypeptide.

8 Claims, 38 Drawing Sheets

Specification includes a Sequence Listing.

(56) References Cited

U.S. PATENT DOCUMENTS

| | | | |
|---|---|---|---|
| 6,056,973 A | 5/2000 | Allen et al. |
| 6,110,498 A | 8/2000 | Rudnic et al. |
| 6,126,966 A | 10/2000 | Abra et al. |
| 6,183,770 B1 | 2/2001 | Muchin et al. |
| 6,254,573 B1 | 7/2001 | Haim et al. |
| 6,284,276 B1 | 9/2001 | Rudnic et al. |
| 6,294,191 B1 | 9/2001 | Meers et al. |
| 6,294,201 B1 | 9/2001 | Kettelhoit et al. |
| 6,309,370 B1 | 10/2001 | Haim et al. |
| 6,316,024 B1 | 11/2001 | Allen et al. |
| 6,352,716 B1 | 3/2002 | Janoff et al. |
| 6,352,721 B1 | 3/2002 | Faour |
| 6,361,796 B1 | 3/2002 | Rudnic et al. |
| 6,406,632 B1 | 6/2002 | Safir et al. |
| 6,406,713 B1 | 6/2002 | Janoff et al. |
| 6,491,916 B1 | 12/2002 | Bluestone et al. |
| 6,514,532 B2 | 2/2003 | Rudnic et al. |
| 6,534,090 B2 | 3/2003 | Puthli et al. |
| 6,572,585 B2 | 6/2003 | Choi |
| 6,713,086 B2 | 3/2004 | Qiu et al. |
| 6,715,485 B1 | 4/2004 | Djupesland |
| 6,743,211 B1 | 6/2004 | Prausnitz et al. |
| 6,759,057 B1 | 7/2004 | Weiner et al. |
| 6,814,979 B2 | 11/2004 | Rudnic et al. |
| 6,838,093 B2 | 1/2005 | Burnside et al. |
| 6,890,918 B2 | 5/2005 | Burnside et al. |
| 6,945,952 B2 | 9/2005 | Kwon |
| 7,294,513 B2 | 11/2007 | Wyatt |
| 8,557,961 B2 | 10/2013 | Silverman et al. |
| 9,249,211 B2 | 2/2016 | Schellenberger et al. |
| 9,976,166 B2 | 5/2018 | Schellenberger et al. |
| 10,870,874 B2 | 12/2020 | Schellenberger et al. |
| 11,713,358 B2 | 8/2023 | Schellenberger et al. |
| 2003/0228309 A1 | 12/2003 | Salcedo et al. |
| 2010/0239554 A1 | 9/2010 | Schellenberger et al. |
| 2010/0323956 A1 | 12/2010 | Schellenberger et al. |
| 2011/0046060 A1 | 2/2011 | Schellenberger et al. |
| 2011/0046061 A1 | 2/2011 | Schellenberger et al. |
| 2011/0077199 A1 | 3/2011 | Schellenberger et al. |
| 2011/0172146 A1 | 7/2011 | Schellenberger et al. |
| 2011/0288005 A1 | 11/2011 | Silverman et al. |
| 2012/0034228 A1 | 2/2012 | Schellenberger et al. |
| 2013/0165389 A1 | 6/2013 | Schellenberger et al. |
| 2017/0016042 A1 | 1/2017 | Schellenberger et al. |
| 2018/0346952 A1 | 12/2018 | Schellenberger et al. |
| 2019/0153115 A1 | 5/2019 | Schellenberger et al. |
| 2020/0385469 A1 | 12/2020 | Yang et al. |
| 2021/0164011 A1 | 6/2021 | Schellenberger et al. |
| 2023/0061715 A1 | 3/2023 | Schellenberger et al. |
| 2023/0121775 A1 | 4/2023 | Schellenberger et al. |
| 2023/0287040 A1 | 9/2023 | Schellenberger et al. |
| 2023/0295334 A1 | 9/2023 | Schellenberger et al. |
| 2023/0312729 A1 | 10/2023 | Schellenberger et al. |
| 2023/0322922 A1 | 10/2023 | Schellenberger et al. |
| 2024/0018260 A1 | 1/2024 | Schellenberger et al. |

FOREIGN PATENT DOCUMENTS

| | | |
|---|---|---|
| WO | WO 2002/079232 A2 | 10/2002 |
| WO | WO 2005/118635 A2 | 12/2005 |
| WO | WO 2007/033230 A2 | 3/2007 |
| WO | WO 2010/091122 A1 | 8/2010 |
| WO | WO 2010/144502 A2 | 12/2010 |
| WO | WO 2010/144508 A1 | 12/2010 |
| WO | WO 2011/028228 A1 | 3/2011 |
| WO | WO 2011/028229 A1 | 3/2011 |
| WO | WO 2011/028344 A2 | 3/2011 |
| WO | WO 2011/123813 A2 | 10/2011 |
| WO | WO 2011/123830 A2 | 10/2011 |
| WO | WO 2014/011819 A2 | 1/2014 |
| WO | WO 2015/023891 A2 | 2/2015 |
| WO | WO 2016/077505 A2 | 5/2016 |
| WO | WO 2017/040344 A2 | 3/2017 |
| WO | WO 2019/126576 A1 | 6/2019 |
| WO | WO 2019/160904 A1 | 8/2019 |
| WO | WO 2020/264200 A1 | 12/2020 |
| WO | WO 2020/264208 A1 | 12/2020 |
| WO | WO 2021/097186 A1 | 5/2021 |

OTHER PUBLICATIONS

Podust et al (Journal of Controlled Release, 2016, vol. 240, pp. 52-66) (Year: 2016).*

Hansen et al, Bioanalytics, e-pub Jul. 2018, 10 pages (Year: 2018).*

Buchanan et al., "Engineering a therapeutic IgG molecule to address cysteinylation, aggregation and enhance thermal stability and expression," mAbs, 2013, 5(2): 255-262.

Calceti et al., "Pharmacokinetic and biodistribution properties of polyethylene glycol)-protein conjugates," Adv. Drug Deliv. Rev., 2003, 55: 1261-1277.

Cattaruzza et al., "Precision-activated T-cell engagers targeting HER2 or EGFR and CD3 mitigate on-target, off-tumor toxicity for immunotherapy in solid tumors," Nature Cancer, Mar. 30, 2023, 4: 485-501.

Datta-Mannan et al., "The interplay of non-specific binding, targetmediated clearance and FcRn interactions on the pharmacokinetics of humanized antibodies," mAbs, Nov./Dec. 2015, 7(6): 1084-1093.

Hendricks et al., "Impact of Tumor HER2/ERBB2 Expression Level on HER2-Targeted Liposomal Doxorubicin-Mediated Drug Delivery: Multiple Low-Affinity Interactions Lead to a Threshold Effect ," Mol. Cancer Ther., Sep. 1, 2013, 12(9): 1816-1828.

Herold et al., "Anti-CD3 Monoclonal Antibody in New-Onset Type 1 Diabetes Mellitus," NEJM, May 30, 2002, 346: 1692-1698.

International Search Report and Written Opinion for PCT International Patent Application No. PCT/US2021/039006, dated Nov. 1, 2021.

Li et al., "Framework selection can influence pharmacokinetics of a humanized therapeutic antibody through differences in molecule charge," mAbs, Sep./Oct. 2014, 6(5): 1255-1264.

Rawlings et al., "MEROPS: the peptidase database," Nucleic Acids Res., 2008, 36(Suppl. 1): D320.

Shalaby et al., "Development of humanized bispecific antibodies reactive with cytotoxic lymphocytes and tumor cells overexpressing the HER2 protooncogene," J. Exp. Med., 1992, 175: 217-225.

Stickler et al., "Human population-based identification of CD4+ T-cell peptide epitope determinants," J Immunol Methods, 2003, 281(1-2): 95-108.

Sturniolo et al., "Generation of tissue-specific and promiscuous HLA ligand databases using DNA microarrays and virtual HLA class II matrices," Nat Biotechnol, 1999, 17: 555-561.

Tunnacliffe et al., "The majority of human CD3 epitopes are conferred by the epsilon chain," Int. Immunol., 1989, 1(5): 546-550.

Van Zoelen et al., "The use of nonhomologous scatchard analysis in the evaluation of ligand-protein interactions," Trends Pharmacol Sciences, 1998, 19(12): 487-490.

Cattaruzza et al., "HER2-XPAT, A Novel Protease-Activatable Prodrug T Cell Engager (TCE), Engineered to Address On-Target, Off Tumor Toxicity and Provide Large Predicted Safety Margins in Non-Human Primates", Amunix Pharmaceuticals, Inc., Mountain View, CA, Dec. 2020.

Cattaruzza et al., "HER2-XPAT, A Novel Protease-Activatable Prodrug T Cell Engager (TCE), Engineered to Address On-Target, Off Tumor Toxicity and Provide Large Predicted Safety Margins in Non-Human Primates", Amunix Pharmaceuticals, Inc., Mountain View, CA, Jun. 2020.

Cattaruzza et al., "HER2-XPAT, A Novel Protease-Activatable Prodrug T Cell Engager (TCE), Engineered to Address On-Target, Off Tumor Toxicity and Provide Large Predicted Safety Margins in Non-Human Primates", Amunix Pharmaceuticals, Inc., Mountain View, CA, Nov. 2020.

Cattaruzza et al., "HER2-XPAT, A Novel Protease-Activatable Prodrug T Cell Engager (TCE), Engineered to Address On-Target, Off Tumor Toxicity and Provide Large Predicted Safety Margins in Non-Human Primates", Amunix Pharmaceuticals, Inc., Mountain View, CA, Sep. 2020.

Cattaruzza et al., "HER2-XPAT, A Novel Protease-Activated Prodrug T Cell Engager (TCE) With Potent T Cell Activation and Efficacy

(56) References Cited

OTHER PUBLICATIONS in Solid Tumor Models and Large Predicted Safety Margins in Non-Human Primates", Amunix Pharmaceuticals, Inc., South San Francisco, CA, Feb. 15, 2021.

To et al., "AMX-818, a Protease-Activated T Cell Engager Targeting HER2 with Potent T Cell Activation, Proteolytic Cleavage and Efficacy in Xenograft Tumors, and Wide Safety Margins in Non-Human Primates", AACR-NCI-EORTC Virtual International Conference on Molecular Targets and Cancer Therapeutics, Oct. 7-10, 2021.

Egloff, et al. Engineered Peptide Barcodes for In-Depth Analyses of Binding Protein Ensembles. Nat Methods. Apr. 2, 20192; 16(5):421-428.

* cited by examiner

HER-2 TARGETED BISPECIFIC COMPOSITIONS AND METHODS FOR MAKING AND USING THE SAME

RELATED APPLICATIONS

This application is a continuation of U.S. patent application Ser. No. 18/064,253, filed Dec. 10, 2022, which is a continuation of International Patent Application No. PCT/US2021/039006, filed Jun. 24, 2021, which claims priority to U.S. Provisional Patent Application Serial Nos. 63/044,301, filed Jun. 25, 2020; 63/077,503, filed Sep. 11, 2020; 63/108,783, filed Nov. 2, 2020; 63/166,857, filed Mar. 26, 2021; and 63/196,408, filed Jun. 3, 2021, the entire disclosures of which are hereby incorporated herein by reference.

SEQUENCE LISTING STATEMENT

The instant application contains a Sequence Listing which has been submitted electronically in XML format and is hereby incorporated by reference in its entirety. Said XML file, created on Oct. 13, 2023, is named 746875_SA9-739PCC0N2_ST26.xml and is 2,734,660 bytes in size.

BACKGROUND

Bispecific T Cell Engagers (TCEs) present a highly potent modality for cancer therapy that redirects T-cell cytotoxicity against tumors that express a selected tumor-associated antigen, bypassing the requirements for T-cell recognition of tumor antigens. The activity of a TCE depends on its ability to activate T cells through effective stimulation of the T cell receptor (TCR). Their extreme potency derives from the minimal requirement for as few as 3 TCRs to become stimulated and coalesce to form an immune synapse between the T cell and target cell to initiate cytotoxicity. In addition to their induction of cytotoxicity, their potency also involves cytokine-driven actions downstream of T-cell activation that enhance and amplify the anti-tumor immune response. Thus, TCEs offer the promise of immunotherapy to patients whose tumors harbor insufficient mutations or have escaped immune surveillance by other means. However, this modality is not without its own challenges and the use of TCEs in solid tumors has been limited by their extreme potency and on target, off-tumor toxicities in healthy tissue.

TCEs have been highly effective at inducing remission in patients with hematologic cancers, but their use in solid tumors has been limited by their extreme potency and on-target toxicities against normal tissue expressing even low levels of target. Impressive, but rare clinical responses have been observed against tumors typically refractory to immunotherapy (e.g., microsatellite-stable colorectal and prostate cancers), but toxicities such as cytokine release syndrome at low doses have prevented dose escalation to reveal the modality's clinical potential. Grade 4 cytokine release syndrome induced in patients treated with the Ichnos ISB 1302 HER2 TCE at <1 ug/kg doses highlights the challenge faced by TCEs even when directed against relatively tissue-restricted targets.

Clinical trials with blinatumomab, (an approved CD3× CD19 bispecific antibody) revealed that cytokine release syndrome (CRS) is one of the major safety-related adverse events. CRS and on-target toxicities at low drug doses have significantly compromised the therapeutic index and potential of the TCE modality in the clinic against solid tumors. For example, the clinical trial for catumaxomab (CD3× EpCAM) was terminated due to drug-related hepatic failure at a 10 g dose. In another trial, a HER2-targeted TCE (Glenmark GBR1302) the dose of the agent was limited to less than 1 g/kg due to onset of G4 CRS. While pasotuxumab (a PSMA-targeted TCE) showed a good response, it was hampered by CRS at doses greater than 40 g/day. The literature is replete with other examples of the CRS and on-target toxicity challenges presented by TCEs.

Attempts to circumvent CRS include complex molecular designs, but these have been unsuccessful due to toxicity and/or enhanced immunogenicity. This presents a significant unmet need for new strategies that can overcome therapeutic index challenges in solid tumors. If the potency of TCEs could be harnessed and the CRS and on-target toxicity challenges could be controlled, it may be possible to generate powerful therapeutics that could potentially be used against a broad spectrum of cancers.

A therapeutic, such as a drug substance includes polypeptides that may be produced in a manner that results in a mixture of polypeptides that can influence activity of the drug substance. The mixture of polypeptides can often include the full-length polypeptide, along with size variants (e.g., truncations) thereof. The presence of variants that differ in size from the desired full-length product may affect the biological behavior of a drug substance, potentially affecting the safety and/or efficacy of the polypeptide drug substance. For example, protein-based prodrugs for cancer therapy may be engineered with a tumor-targeted activation mechanism. More specifically, the full-length therapeutic protein may be an inactive (non-cytotoxic) prodrug form, while truncation variants of the full-length construct may lose protective sequences and become cytotoxic (active), thus "contaminating" the prodrug composition. In some instances, such shorter length variants may pose a greater risk of immunogenicity, have less selective toxicity for tumor cells, or show a less desired pharmacokinetic profile (e.g., resulting in a narrowed therapeutic window) compared with the full-length protein. As a result, detection and quantification of protein structural variations can be of importance in assessing biological properties (e.g., clinical safety and pharmacologic efficacy) of biotherapeutics and in developing new biotherapeutics (e.g., with increased efficacy and reduced side effects). Existing techniques and methods for identifying and quantifying the amount of "contaminating" truncation products may include one or more drawbacks, such as being of limited sensitivity, ease, efficiency, or effectiveness.

SUMMARY

The present invention addresses a long-felt unmet need in providing TCE cancer therapeutics that have an increased therapeutic index. In doing so, the invention harnesses the therapeutic potential of TCEs by providing XTENylated protease activated bispecific T cell engagers (XPATs). XPATs represent a novel strategy to improve the toxicity profile of T cell engagers while maintaining their potency against solid tumors, thus enabling a significant increase in the therapeutic index and expansion of target landscape for this potent modality. In certain specific embodiments, the XPATs of the present invention target HER2-bearing tumors. More specifically, AMX-818 is a HER2-targeted, conditionally activated prodrug TCE designed to exploit the dysregulated protease activity in tumors, while sparing healthy tissues where protease inhibition prevails, thus broadening the safety margin and therapeutic index Provided herein is a polypeptide having an N-terminal amino acid and a C-terminal amino acid, the polypeptide comprising: (a) an extended recombinant polypeptide (XTEN), comprising a barcode fragment (BAR) releasable from said polypeptide upon digestion by a protease; (b) a bispecific antibody construct (BsAb), comprising a first antigen binding fragment (AF1) that specifically binds to a cluster of differentiation 3 T cell receptor (CD3), which AF1 comprises light chain complementarity-determining regions 1 (CDR-L1), 2 (CDR-L2), and 3 (CDR-L3) and heavy chain complementarity-determining regions 1 (CDR-H1), 2 (CDR-H2), and 3 (CDR-H3), wherein said CDR-H3 comprises an amino acid sequence of SEQ ID NO:10; and a second antigen binding fragment (AF2) that specifically binds to human epidermal growth factor receptor 2 (HER2); and (c) a release segment (RS) positioned between said XTEN and said bispecific antibody construct, wherein said XTEN is characterized in that: (i) it comprises at least 100, or at least 150 amino acids; (ii) at least 90% of its amino acid residues are glycine (G), alanine (A), serine (S), threonine (T), glutamate (E) or proline (P); (iii) it comprises at least 4 different types of amino acids that are G, A, S, T, E, or P; and (iv) said XTEN is formed from a plurality of non-overlapping sequence motifs that are each from 9 to 14 amino acids in length, wherein said plurality of non-overlapping sequence motifs comprise: (1) a set of non-overlapping sequence motifs, wherein each non-overlapping sequence motif of said set of non-overlapping sequence motifs is repeated at least two times in said XTEN; and (2) a non-overlapping sequence motif that occurs only once within said XTEN; wherein said barcode fragment (BAR) includes at least part of said non-overlapping sequence motif that occurs only once within said XTEN; wherein said barcode fragment (BAR) differs in sequence and molecular weight from all other peptides fragments that are releasable from said polypeptide upon complete digestion of said polypeptide by said protease; and wherein said barcode fragment (BAR) does not include said N-terminal amino acid or said C-terminal amino acid of said polypeptide.

In certain embodiments, said set of non-overlapping sequence motifs each independently comprise an amino acid sequence identified herein by SEQ ID NOS: 179-200 and 1715-1722. In certain embodiments, said set of non-overlapping sequence motifs each independently comprise an amino acid sequence identified herein by SEQ ID NOS: 186-189. In certain embodiments, said set of non-overlapping sequence motifs comprise at least two, at least three, or all four of the sequence motifs SEQ ID NOS: 186-189. In certain embodiments, said XTEN comprises a length of from 100 to 3,000, from 150 to 3,000, from 100 to 1,000, or from 150 to 1,000 amino acid residues. In certain embodiments, said XTEN comprises a length of at least 200, at least 250, at least 300, at least 350, at least 400, at least 450, or at least 500 amino acid residues. In certain embodiments, at least 91%, 92%, 93%, 94%, 95%, 96%, 97%, 98%, 99% or 100% of the amino acid residues of said XTEN are glycine (G), alanine (A), serine (S), threonine (T), glutamate (E) or proline (P).

In certain embodiments, said XTEN has at least 90%, at least 92%, at least 95%, at least 98%, at least 99% or 100% sequence identity to a sequence set forth in Table 3a. In certain embodiments, said barcode fragment (BAR) does not include a glutamic acid that is immediately adjacent to another glutamic acid, if present, in said XTEN. In certain embodiments, said barcode fragment (BAR) has a glutamic acid at its C-terminus. In certain embodiments, said barcode fragment (BAR) has an N-terminal amino acid that is immediately preceded by a glutamic acid residue. In certain embodiments, said barcode fragment (BAR) is positioned a distance from either said N-terminus of said polypeptide or said C-terminus of said polypeptide, wherein said distance is from 10 to 150 amino acids, or from 10 to 125 amino acids in length. In certain embodiments, said barcode fragment (BAR) is characterized in that: (i) it does not include a glutamic acid that is immediately adjacent to another glutamic acid, if present, in said XTEN; (ii) it has a glutamic acid at its C-terminus; (iii) it has an N-terminal amino acid that is immediately preceded by a glutamic acid residue; and (iv) it is positioned a distance from either said N-terminus of said polypeptide or said C-terminus of said polypeptide, wherein said distance is from 10 to 150 amino acids, or from 10 to 125 amino acids in length. In certain embodiments, said glutamic acid residue that precedes said N-terminal amino acid of said barcode fragment (BAR) is not immediately adjacent to another glutamic acid residue.

In certain embodiments, said barcode fragment (BAR) does not include a second glutamic acid residue at a position other than the C-terminus of said barcode fragment unless said second glutamic acid is immediately followed by a proline. In certain embodiments, said XTEN is positioned N-terminal of said bispecific antibody construct (BsAb), wherein said barcode fragment (BAR) is positioned within 200, within 150, within 100, or within 50 amino acids of said N-terminus of said polypeptide. In certain embodiments, said XTEN is positioned N-terminal of said bispecific antibody construct (BsAb), and wherein said barcode fragment (BAR1) is positioned at a location that is between 10 and 200, between 30 and 200, between 40 and 150, or between 50 and 100 amino acids from said N-terminus of said protein. In certain embodiments, said XTEN is positioned C-terminal of said bispecific antibody construct (BsAb), and wherein said barcode fragment (BAR) is positioned within 200, within 150, within 100, or within 50 amino acids of said C-terminus of said polypeptide. In certain embodiments, said XTEN is positioned C-terminal of said bispecific antibody construct (BsAb), and said barcode fragment (BAR) is positioned at a location that is between 10 and 200, between 30 and 200, between 40 and 150, or between 50 and 100 amino acids from said C-terminus of said protein. In certain embodiments, said barcode fragment (BAR) is at least 4 amino acids in length. In certain embodiments, said barcode fragment (BAR) is between 4 and 20, between 5 and 15, between 6 and 12, or between 7 and 10 amino acids in length.

In certain embodiments, said barcode fragment (BAR) comprises an amino acid sequence set forth in Table 2. In certain embodiments, said XTEN has a length defined by a proximal end and a distal end, wherein (1) said proximal end is positioned, relative to said distal end, closer to said bispecific antibody construct (BsAb), and wherein (2) said barcode fragment (BAR) is positioned within a region of said XTEN that extends, as measured from said distal end, between 5% and 50%, between 7% and 40%, or between 10% and 30% of said length of said XTEN. In certain embodiments, said XTEN further comprises additional one or more barcode fragments, wherein said additional one or more barcode fragments each differ in sequence and molecular weight from all other peptides fragments that are releasable from said polypeptide upon complete digestion of said polypeptide by said protease. In certain embodiments, said release segment (RS) comprises an amino acid sequence having at least 90%, 91%, 92%, 93%, 94%, 95%, 96%, 97%, 98%, 99% or 100% sequence identity to a sequence identified herein by SEQ ID NOS: 7001-7626. In certain embodiments, said protease cleaves on the C-terminal side of glutamic acid residues that are not followed by proline. In certain embodiments, said protease is a Glu-C protease.

In certain embodiments, the polypeptide is expressed as a fusion protein, wherein said fusion protein, in an uncleaved state, has a structural arrangement from N-terminus to C-terminus that is AF1-AF2-RS-XTEN, AF2-AF1-RS-XTEN, XTEN-RS-AF1-AF2, or XTEN-RS-AF2-AF1. In certain embodiments, said release segment (RS) is fused to said bispecific antibody construct (BsAb) by a spacer. In certain embodiments, said spacer comprises at least 4 types of amino acids that can be glycine (G), alanine (A), serine (S), threonine (T), glutamate (E) or proline (P). In certain embodiments, said spacer comprises an amino acid sequence having at least 80%, 90%, or 100% sequence identity to a sequence set forth in Table C. In certain embodiments, said CDR-H1 and said CDR-H2 of said first antigen binding fragment (AF1) comprise amino acid sequences of SEQ ID NOS: 8 and 9, respectively.

In certain embodiments, said CDR-L1 of said AF1 comprises an amino acid sequence of SEQ ID NO:1 or 2; said CDR-L2 of said AF1 comprises an amino acid sequence of SEQ ID NO:4 or 5; and said CDR-L3 of said AF1 comprises an amino acid sequence of SEQ ID NO:6. In certain embodiments, said CDR-L1 of said AF1 comprises an amino acid sequence of SEQ ID NO:1; said CDR-L2 of said AF1 comprises an amino acid sequence of SEQ ID NO:4 or 5; and said CDR-L3 of said AF1 comprises an amino acid sequence of SEQ ID NO:6. In certain embodiments, said CDR-L1 of said AF1 comprises an amino acid sequence of SEQ ID NO:2; said CDR-L2 of said AF1 comprises an amino acid sequence of SEQ ID NO:4 or 5; and said CDR-L3 of said AF1 comprises an amino acid sequence of SEQ ID NO:6. In certain embodiments, said CDR-L1 of said AF1 comprises an amino acid sequence of SEQ ID NO:1; said CDR-L2 of said AF1 comprises an amino acid sequence of SEQ ID NO:4; and said CDR-L3 of said AF1 comprises an amino acid sequence of SEQ ID NO:6. In certain embodiments, said CDR-L1 of said AF1 comprises an amino acid sequence of SEQ ID NO:2; said CDR-L2 of said AF1 comprises an amino acid sequence of SEQ ID NO:5; and said CDR-L3 of said AF1 comprises an amino acid sequence of SEQ ID NO:6. In certain embodiments, said first antigen binding fragment (AF1) comprises four chain variable domain framework regions 1 (FR-H1), 2 (FR-H2), 3 (FR-H3), and 4 (FR-H4), each exhibiting at least 86%, 87%, 88%, 89%, 90%, 91%, 92%, 93%, 94%, 95%, 96%, 97%, 98%, or 99% sequence identity or being identical to an amino acid sequence of SEQ ID NOS: 60, 64, 65, and 67, respectively. In certain embodiments, said first antigen binding fragment (AF1) comprises four chain variable domain framework regions 1 (FR-H1), 2 (FR-H2), 3 (FR-H3), and 4 (FR-H4), each exhibiting at least 86%, 87%, 88%, 89%, 90%, 91%, 92%, 93%, 94%, 95%, 96%, 97%, 98%, or 99% sequence identity or being identical to an amino acid sequence of SEQ ID NOS: 61, 64, 65, and 67, respectively. In certain embodiments, said first antigen binding fragment further comprises four light chain variable domain framework regions (FR-L): FR-L1, FR-L2, FR-L3, and FR-L4, each exhibiting at least 86%, 87%, 88%, 89%, 90%, 91%, 92%, 93%, 94%, 95%, 96%, 97%, 98%, or 99% sequence identity or being identical to amino acid sequences of SEQ ID NOS: 51, 52, 53, and 59, respectively. In certain embodiments, said first antigen binding fragment further comprises four light chain variable domain framework regions (FR-L): FR-L1, FR-L2, FR-L3, and FR-L4, each exhibiting at least 86%, 87%, 88%, 89%, 90%, 91%, 92%, 93%, 94%, 95%, 96%, 97%, 98%, or 99% sequence identity or being identical to amino acid sequences of SEQ ID NOS: 51, 52, 54, and 59, respectively.

In certain embodiments, said first antigen binding fragment further comprises four light chain variable domain framework regions (FR-L): FR-L1, FR-L2, FR-L3, and FR-L4, each exhibiting at least 86%, 87%, 88%, 89%, 90%, 91%, 92%, 93%, 94%, 95%, 96%, 97%, 98%, or 99% sequence identity or being identical to amino acid sequences of SEQ ID NOS: 51, 52, 55, and 59, respectively. In certain embodiments, said first antigen binding fragment further comprises four light chain variable domain framework regions (FR-L): FR-L1, FR-L2, FR-L3, and FR-L4, each exhibiting at least 86%, 87%, 88%, 89%, 90%, 91%, 92%, 93%, 94%, 95%, 96%, 97%, 98%, or 99% sequence identity or being identical to amino acid sequences of SEQ ID NOS: 51, 52, 56, and 59, respectively. In certain embodiments, said first antigen binding fragment (AF1) further comprises light chain framework regions 1 (FR-L1), 2 (FR-L2), 3 (FR-L3), and 4 (FR-L4) and heavy chain framework regions 1 (FR-H1), 2 (FR-H2), 3 (FR-H3) and 4 (FR-H4), wherein: said FR-L1 comprises an amino acid sequence of SEQ ID NO:51; said FR-L2 comprises an amino acid sequence of SEQ ID NO:52; said FR-L3 comprises an amino acid sequence of SEQ ID NO:53, 54, 55, or 56; said FR-L4 comprises an amino acid sequence of SEQ ID NO:59; said FR-H1 comprises an amino acid sequence of SEQ ID NO:60 or 61; said FR-H2 comprises an amino acid sequence of SEQ ID NO:64; said FR-H3 comprises an amino acid sequence of SEQ ID NO:65; and said FR-H4 comprises an amino acid sequence of SEQ ID NO:67.

In certain embodiments, said first antigen binding fragment (AF1) further comprises light chain framework regions 1 (FR-L1), 2 (FR-L2), 3 (FR-L3), and 4 (FR-L4) and heavy chain framework regions 1 (FR-H1), 2 (FR-H2), 3 (FR-H3) and 4 (FR-H4), wherein: said FR-L1 comprises an amino acid sequence of SEQ ID NO:51; said FR-L2 comprises an amino acid sequence of SEQ ID NO:52; said FR-L3 comprises an amino acid sequence of SEQ ID NO:53; said FR-L4 comprises an amino acid sequence of SEQ ID NO:59; said FR-H1 comprises an amino acid sequence of SEQ ID NO:60; said FR-H2 comprises an amino acid sequence of SEQ ID NO:64; said FR-H3 comprises an amino acid sequence of SEQ ID NO:65; and said FR-H4 comprises an amino acid sequence of SEQ ID NO:67.

In certain embodiments, said first antigen binding fragment (AF1) further comprises light chain framework regions 1 (FR-L1), 2 (FR-L2), 3 (FR-L3), and 4 (FR-L4) and heavy chain framework regions 1 (FR-H1), 2 (FR-H2), 3 (FR-H3) and 4 (FR-H4), wherein: said FR-L1 comprises an amino acid sequence of SEQ ID NO:51; said FR-L2 comprises an amino acid sequence of SEQ ID NO:52; said FR-L3 comprises an amino acid sequence of SEQ ID NO:54; said FR-L4 comprises an amino acid sequence of SEQ ID NO:59; said FR-H1 comprises an amino acid sequence of SEQ ID NO:61; said FR-H2 comprises an amino acid sequence of SEQ ID NO:64; said FR-H3 comprises an amino acid sequence of SEQ ID NO:65; and said FR-H4 comprises an amino acid sequence of SEQ ID NO:67.

In certain embodiments, said first antigen binding fragment (AF1) further comprises light chain framework regions 1 (FR-L1), 2 (FR-L2), 3 (FR-L3), and 4 (FR-L4) and heavy chain framework regions 1 (FR-H1), 2 (FR-H2), 3 (FR-H3) and 4 (FR-H4), wherein: said FR-L1 comprises an amino acid sequence of SEQ ID NO:51; said FR-L2 comprises an amino acid sequence of SEQ ID NO:52; said FR-L3 comprises an amino acid sequence of SEQ ID NO:55; said FR-L4 comprises an amino acid sequence of SEQ ID NO:59; said FR-H1 comprises an amino acid sequence of SEQ ID NO:61; said FR-H2 comprises an amino acid sequence of SEQ ID NO:64; said FR-H3 comprises an amino acid sequence of SEQ ID NO:65; and said FR-H4 comprises an amino acid sequence of SEQ ID NO:67.

In certain embodiments, said first antigen binding fragment (AF1) further comprises light chain framework regions 1 (FR-L1), 2 (FR-L2), 3 (FR-L3), and 4 (FR-L4) and heavy chain framework regions 1 (FR-H1), 2 (FR-H2), 3 (FR-H3) and 4 (FR-H4), wherein: said FR-L1 comprises an amino acid sequence of SEQ ID NO:51; said FR-L2 comprises an amino acid sequence of SEQ ID NO:52; said FR-L3 comprises an amino acid sequence of SEQ ID NO:56; said FR-L4 comprises an amino acid sequence of SEQ ID NO:59; said FR-H1 comprises an amino acid sequence of SEQ ID NO:61; said FR-H2 comprises an amino acid sequence of SEQ ID NO:64; said FR-H3 comprises an amino acid sequence of SEQ ID NO:65; and said FR-H4 comprises an amino acid sequence of SEQ ID NO:67.

In certain embodiments, said first antigen binding fragment (AF1) exhibits a higher thermal stability than an anti-CD3 binding fragment having a sequence set forth in SEQ ID NO: 206, as evidenced in an in vitro assay by a higher melting temperature ($T_m$) of said first antigen binding fragment relative to that of said anti-CD3 binding fragment; or upon incorporating said first antigen binding fragment into a test bispecific antigen binding construct, a higher $T_m$ of said test bispecific antigen binding construct relative to that of a control bispecific antigen binding construct, wherein said test bispecific antigen binding construct comprises said first antigen binding fragment and a reference antigen binding fragment that binds to an antigen other than CD3; and wherein said control bispecific antigen binding construct consists of said anti-CD3 binding fragment consisting of said sequence of SEQ ID NO:206 and said reference antigen binding fragment. In certain embodiments, said $T_m$ of said first antigen binding fragment is at least 2° C. greater, or at least 3° C. greater, or at least 4° C. greater, or at least 5° C. greater than said $T_m$ of said anti-CD3 binding fragment consisting of said sequence of SEQ ID NO:206. In certain embodiments, said first antigen binding fragment (AF1) comprises a heavy chain variable region ($VH_1$), wherein said $VH_1$ comprises an amino acid sequence having at least 90%, 91%, 92%, 93%, 94%, 95%, 96%, 97%, 98%, 99% sequence identity or being identical to an amino acid sequence of SEQ ID NO:102 or 105. In certain embodiments, said first antigen binding fragment (AF1) comprises a light chain variable region ($VL_1$), wherein said $VL_1$ comprises an amino acid sequence having at least 90%, 91%, 92%, 93%, 94%, 95%, 96%, 97%, 98%, 99% sequence identity or is identical to an amino acid sequence of any one of SEQ ID NOS: 101, 103, 104, 106, or 107. In certain embodiments, said $VH_1$ and said $VL_1$ is linked by a linker comprising an amino acid sequence having at least 90%, 91%, 92%, 93%, 94%, 95%, 96%, 97%, 98%, 99% or 100% sequence identity to a sequence set forth in Table A. In certain embodiments, said first antigen binding fragment (AF1) comprises an amino acid sequence having at least 95%, 96%, 97%, 98%, 99% sequence identity or being identical to an amino acid sequence of any one of SEQ ID NOS: 201-205. In certain embodiments, said first antigen binding fragment (AF1) specifically binds human or cynomolgus monkey (cyno) CD3. In certain embodiments, said first antigen binding fragment (AF1) specifically binds human CD3. In certain embodiments, said first antigen binding fragment (AF1) binds a CD3 complex subunit that is CD3 epsilon, CD3 delta, CD3 gamma, or CD3 zeta unit of CD3. In certain embodiments, said first antigen binding fragment (AF1) binds a CD3 epsilon fragment of CD3. In certain embodiments, said first antigen binding fragment (AF1) exhibits an isoelectric point (pI) that is less than or equal to 6.6. In certain embodiments, said first antigen binding fragment (AF1) exhibits an isoelectric point (pI) that is between 6.0 and 6.6, inclusive.

In certain embodiments, said first antigen binding fragment (AF1) exhibits an isoelectric point (pI) that is at least 0.1, 0.2, 0.3, 0.4, 0.5, 0.6, 0.7, 0.8, 0.9, or 1.0 pH units lower than the pI of a reference antigen binding fragment having a sequence shown in SEQ ID NO: 206. In certain embodiments, said first antigen binding fragment (AF1) specifically binds human or cyno CD3 with a dissociation constant ($K_d$) constant between about between about 10 nM and about 400 nM, as determined in an in vitro antigen-binding assay comprising a human or cyno CD3 antigen. In certain embodiments, said first antigen binding fragment (AF1) specifically binds human or cyno CD3 with a dissociation constant ($K_d$) of less than about 10 nM, or less than about 50 nM, or less than about 100 nM, or less than about 150 nM, or less than about 200 nM, or less than about 250 nM, or less than about 300 nM, or less than about 350 nM, or less than about 400 nM, as determined in an in vitro antigen-binding assay. In certain embodiments, said first antigen binding fragment (AF1) exhibits a binding affinity to CD3 that is at least 2-fold, 3-fold, 4-fold, 5-fold, 6-fold, 7-fold, 8-fold, 9-fold, or at least 10-fold weaker relative to that of an antigen binding fragment consisting of an amino acid sequence of SEQ ID NO:206, as determined by the respective dissociation constants ($K_d$) in an in vitro antigen-binding assay.

In certain embodiments, said first antigen binding fragment (AF1) is a chimeric or a humanized antigen binding fragment. In certain embodiments, said first antigen binding fragment (AF1) is Fv, Fab, Fab', Fab'-SH, linear antibody, or single-chain variable fragment (scFv). In certain embodiments, said second antigen binding fragment (AF2) is Fv, Fab, Fab', Fab'-SH, linear antibody, a single domain antibody, or single-chain variable fragment (scFv). In certain embodiments, said first and second antigen binding fragments are configured as an (Fab')$_2$ or a single chain diabody. In certain embodiments, said second antigen binding fragment (AF2) comprises a heavy chain variable region ($VH_{II}$) comprising an amino acid sequence identified herein by SEQ ID NOS: 778-783, and a light chain variable region ($VL_{II}$) comprising an amino acid sequence identified herein by SEQ ID NOS: 878-883. In certain embodiments, said $VH_{II}$ and said $VL_{II}$ is linked by a linker comprising an amino acid sequence having at least 90%, 91%, 92%, 93%, 94%, 95%, 96%, 97%, 98%, 99% or 100% sequence identity to a sequence set forth in Table A. In certain embodiments, said first and second antigen binding fragments are fused together by a peptide linker. In certain embodiments, said peptide linker comprises 2 or 3 types of amino acids that are glycine, serine, or proline. In certain embodiments, said peptide linker comprises an amino acid sequence having at least 90%, 91%, 92%, 93%, 94%, 95%, 96%, 97%, 98%, 99% or 100% sequence identity to a sequence set forth in Table B.

In certain embodiments, said XTEN is a first extended recombinant polypeptide (XTEN1); formed from a plurality of non-overlapping sequence motifs, comprising a first plurality of non-overlapping sequence motifs; said BAR is a first barcode fragment (BAR1); and said RS is a first release segment (RS1); and the polypeptide further comprising: (d)

a second extended recombinant polypeptide (XTEN2), comprising a second barcode fragment (BAR2) releasable from said polypeptide upon digestion by said protease; and (e) a second release segment (RS2) positioned between said second XTEN (XTEN2) and said bispecific antibody construct (BsAb), wherein said XTEN2 is characterized in that: (i) it comprises at least 100, or at least 150 amino acids; (ii) at least 90% of its amino acid residues that are glycine (G), alanine (A), serine (S), threonine (T), glutamate (E) or proline (P); and (iii) it comprises at least 4 different types of amino acids that are G, A, S, T, E, or P; wherein said second barcode fragment (BAR2) differs in sequence and molecular weight from all other peptides fragments that are releasable from said polypeptide upon complete digestion of said polypeptide by said protease; and wherein said second barcode fragment (BAR2) does not include said N-terminal amino acid or said C-terminal amino acid of said polypeptide. In certain embodiments, said XTEN1 is positioned N-terminal of said bispecific antibody construct and said XTEN2 is positioned C-terminal of said bispecific antibody construct. In certain embodiments, said XTEN1 is positioned C-terminal of said bispecific antibody construct and said XTEN2 is positioned N-terminal of said bispecific antibody construct.

In certain embodiments, said XTEN2 is formed from a second plurality of non-overlapping sequence motifs that are each from 9 to 14 amino acids in length, wherein said second plurality of non-overlapping sequence motifs comprise: (1) a second set of non-overlapping sequence motifs repeated at least two times in said second XTEN; and (2) a non-overlapping sequence motif that occurs only once within said second XTEN; and wherein said second barcode fragment (BAR2) includes at least part of said non-overlapping sequence motif that occurs only once within said second XTEN. In certain embodiments, said second set of non-overlapping sequence motifs are each independently identified herein by SEQ ID NOS: 179-200 and 1715-1722. In certain embodiments, said second set of non-overlapping sequence motifs are each independently identified herein by SEQ ID NOS: 186-189. In certain embodiments, said second set of non-overlapping sequence motifs comprise at least two, at least three, or all four of the sequence motifs SEQ ID NOS: 186-189. In certain embodiments, said XTEN2 comprises a length of from 100 to 3,000, from 150 to 3,000, from 100 to 1,000, or from 150 to 1,000 amino acid residues. In certain embodiments, said XTEN2 comprises a length of at least 200, at least 250, at least 300, at least 350, at least 400, at least 450, or at least 500 amino acid residues.

In certain embodiments, at least 91%, 92%, 93%, 94%, 95%, 96%, 97%, 98%, 99% or 100% of the amino acid residues of said XTEN2 are glycine (G), alanine (A), serine (S), threonine (T), glutamate (E) or proline (P). In certain embodiments, said XTEN2 has at least 90%, at least 92%, at least 95%, at least 98%, at least 99% or 100% sequence identity to a sequence set forth in Table 3a. In certain embodiments, said second barcode fragment (BAR2) does not include a glutamic acid that is immediately adjacent to another glutamic acid, if present, in said XTEN2. In certain embodiments, said second barcode fragment (BAR2) has a glutamic acid at its C-terminus. In certain embodiments, said second barcode fragment (BAR2) has an N-terminal amino acid that is immediately preceded by a glutamic acid residue. In certain embodiments, said second barcode fragment (BAR2) is positioned a distance from either said N-terminus of said polypeptide or said C-terminus of said polypeptide, wherein said distance is from 10 to 150 amino acids, or from 10 to 125 amino acids in length. In certain embodiments, said second barcode fragment (BAR2) is characterized in that (i) it does not include a glutamic acid that is immediately adjacent to another glutamic acid, if present, in said XTEN2; (ii) it has a glutamic acid at its C-terminus; (iii) it has an N-terminal amino acid that is immediately preceded by a glutamic acid residue; and (iv) it is positioned a distance from either said N-terminus of said polypeptide or said C-terminus of said polypeptide, wherein said distance is from 10 to 150 amino acids, or from 10 to 125 amino acids in length.

In certain embodiments, said glutamic acid residue that precedes said N-terminal amino acid of said BAR2 is not immediately adjacent to another glutamic acid residue. In certain embodiments, said second barcode fragment (BAR2) does not include a second glutamic acid residue at a position other than the C-terminus of said second barcode fragment (BAR2) unless said second glutamic acid is immediately followed by a proline. In certain embodiments, said XTEN2 is positioned N-terminal of said bispecific antibody construct (BsAb), and wherein said second barcode fragment (BAR2) is positioned within 200, within 150, within 100, or within 50 amino acids of said N-terminus of said polypeptide. In certain embodiments, said XTEN2 is positioned N-terminal of said bispecific antibody construct (BsAb), and wherein said second barcode fragment (BAR2) is positioned at a location that is between 10 and 200, between 30 and 200, between 40 and 150, or between 50 and 100 amino acids from said N-terminus of said protein. In certain embodiments, said XTEN2 is positioned C-terminal of said bispecific antibody construct (BsAb), and wherein said second barcode fragment (BAR2) is positioned within 200, within 150, within 100, or within 50 amino acids of said C-terminus of said polypeptide. In certain embodiments, said XTEN2 is positioned C-terminal of said bispecific antibody construct (BsAb), and said second barcode fragment (BAR2) is positioned at a location that is between 10 and 200, between 30 and 200, between 40 and 150, or between 50 and 100 amino acids from said C-terminus of said protein.

In certain embodiments, said second barcode fragment (BAR2) is at least 4 amino acids in length. In certain embodiments, said second barcode fragment (BAR2) is between 4 and 20, between 5 and 15, between 6 and 12, or between 7 and 10 amino acids in length. In certain embodiments, said second barcode fragment (BAR2) comprises an amino acid sequence as set forth in Table 2. In certain embodiments, said XTEN2 has a length defined by a proximal end and a distal end, wherein (1) said proximal end of said XTEN2 is positioned, relative to said distal end, closer to said bispecific antibody construct (BsAb), and wherein (2) said second barcode fragment (BAR2) is positioned within a region of said XTEN2 that extends, as measured from said distal end of said XTEN2, between 5% and 50%, between 7% and 40%, or between 10% and 30% of said length of said XTEN2. In certain embodiments, said XTEN2 further comprises additional one or more barcode fragments, wherein said additional one or more barcode fragments of said XTEN2 each differ in sequence and molecular weight from all other peptides fragments that are releasable from said polypeptide upon complete digestion of said polypeptide by said protease. In certain embodiments, said first release segment (RS1) and said second release segment (RS2) are identical in sequence. In certain embodiments, said first release segment (RS1) and said second release segment (RS2) are not identical in sequence. In certain embodiments, said second release segment (RS2) comprises an amino acid sequence having at least 90%, 91%, 92%, 93%, 94%, 95%, 96%, 97%, 98%, 99% or 100% sequence identity to a sequence identified herein by SEQ ID NOS: 7001-7626. In certain embodiments, said first release segment (RS1) and said second release segment (RS2) are each a substrate for cleavage by multiple proteases at one, two, or three cleavage sites within each release segment sequence.

In certain embodiments, a polypeptide is expressed as a fusion protein, wherein said fusion protein, in an uncleaved state, has a structural arrangement from N-terminus to C-terminus identified herein by XTEN1-RS1-AF1-AF2-RS2-XTEN2, XTEN1-RS1-AF2-AF1-RS2-XTEN2, XTEN2-RS2-AF1-AF2-RS1-XTEN1, XTEN2-RS2-AF2-AF1-RS1-XTEN1, XTEN1-RS1-diabody-RS2-XTEN2, or XTEN2-RS2-diabody-RS1-XTEN1, wherein said diabody comprises a light chain variable region (VL$_1$) of said AF1, a heavy chain variable region (VH$_1$) of said AF1, a light chain variable region (VL$_{II}$) of said AF2, and a heavy chain variable region (VH$_{II}$) of said AF2. In certain embodiments, said spacer of said first release segment (RS1) is a first spacer, and wherein said second release segment (RS2) is fused to said bispecific antibody construct (BsAb) by a second spacer. In certain embodiments, said second spacer comprises at least 4 types of amino acids that are glycine (G), alanine (A), serine (S), threonine (T), glutamate (E) or proline (P). In certain embodiments, said second spacer comprises an amino acid sequence having at least 90%, 91%, 92%, 93%, 94%, 95%, 96%, 97%, 98%, 99% or 100% sequence identity to a sequence set forth in Table C.

In certain embodiments, said XTEN1 comprises an amino acid sequence having at least about 90%, 91%, 92%, 93%, 94%, 95%, 96%, 97%, 98%, 99%, or 100% sequence identity to a sequence set forth in Table 3a; said BsAb comprises: said AF1 comprising light chain complementarity-determining regions 1 (CDR-L1), 2 (CDR-L2), and 3 (CDR-L3) and heavy chain complementarity-determining regions 1 (CDR-H1), 2 (CDR-H2), and 3 (CDR-H3), wherein said CDR-H1, said CDR-H2, and said CDR-H3 comprise amino acid sequences of SEQ ID NOS: 8, 9, and 10, respectively; and said AF2 comprising a light chain variable region (VL$_{II}$) identified herein by SEQ ID NOS: 778-783 and a heavy chain variable region (VH$_{II}$) identified herein by SEQ ID NOS: 878-883; said RS1 comprises an amino acid sequence having at least 90%, 91%, 92%, 93%, 94%, 95%, 96%, 97%, 98%, 99%, or 100% sequence identity to a sequence identified herein by SEQ ID NOS: 7001-7626; said XTEN2 comprises an amino acid sequence having at least about 90%, 91%, 92%, 93%, 94%, 95%, 96%, 97%, 98%, 99%, or 100% sequence identity to a sequence set forth in Table 3a; and said RS2 comprises an amino acid sequence having at least 90%, 91%, 92%, 93%, 94%, 95%, 96%, 97%, 98%, 99%, or 100% sequence identity to a sequence identified herein by SEQ ID NOS: 7001-7626, wherein said polypeptide has a structural arrangement from N-terminus to C-terminus identified herein as XTEN1-RS1-AF2-AF1-RS2-XTEN2, XTEN1-RS1-AF1-AF2-RS2-XTEN2, XTEN2-RS2-AF2-AF1-RS1-XTEN1, or XTEN2-RS2-AF1-AF2-RS1-XTEN1.

In certain embodiments, the polypeptide has a terminal half-life that is at least two-fold longer compared to the bispecific antibody construct not linked to any XTEN. In certain embodiments, the polypeptide is less immunogenic compared to the bispecific antibody construct not linked to any XTEN, as ascertained by measuring production of IgG antibodies that selectively bind to said bispecific antibody construct after administration of comparable doses to a subject. In certain embodiments, the polypeptide exhibits an apparent molecular weight factor under physiological conditions that is greater than about 3, greater than about 4, greater than about 5, or greater than about 6. In certain embodiments, the polypeptide comprises an amino acid sequence having at least 90%, 91%, 92%, 93%, 94%, 95%, 96%, 97%, 98%, 99% or 100% sequence identity to a sequence identified herein as the sequences in Table D.

In certain embodiments, a pharmaceutical composition comprises a polypeptide as above and one or more pharmaceutically suitable excipients. In certain embodiments, said pharmaceutical composition is formulated for administration to a human or animal by any clinically appropriate route and formulation. In certain embodiments, said pharmaceutical composition is in a liquid form or frozen. In certain embodiments, said pharmaceutical composition is in a pre-filled syringe for a single injection. In certain embodiments, said pharmaceutical composition is formulated as a lyophilized powder to be reconstituted prior to administration.

In certain embodiments said composition is in a pharmaceutical combination with at least one additional therapeutic agent selected from the group consisting of an antibody, an antibody fragment, an antibody conjugate, a cytotoxic agent, a toxin, a radionuclide, an immunomodulator, a photoactive therapeutic agent, a radiosensitizing agent, a hormone, an anti-angiogenesis agent, and combinations thereof.

The additional therapeutic agent may be a PD-1/PD-L1(2) inhibitor wherein the PD-1/PD-L1(2) inhibitor is an anti-PD-1 antibody or an anti-PD-L1 antibody or an anti-PD-L2 antibody.

In certain embodiments the PD-1/PD-L1(2) inhibitor is an anti-PD-1 antibody selected from the group comprising nivolumab (Opdivo, BMS-936558, MDX1106), pembrolizumab (Keytruda, MK-3475, lambrolizumab), pidilizumab (CT-011), PDR-001, JS001, STI-A1110, AMP-224 and AMP-514 (MEDI0680).

In one embodiment the PD-1/PD-L1(2) inhibitor can be an anti-PD-L1 antibody selected from the group comprising atezolizumab (Tecentriq, MPDL3280A), durvalumab (MED14736), avelumab (MSB0010718C), BMS-936559 (MDX1105) and LY3300054. In another embodiment the PD-1/PD-L1(2) inhibitor is an anti-PD-L2 antibody.

In certain embodiments the combination is a combination pack containing the components separate from one another. In certain embodiments the components are administered in separate dosage forms simultaneously or sequentially for use in the treatment of the same disease.

In certain embodiments the polypeptide described herein is part of a pharmaceutical combination for use as medicament for treating hyper-proliferative disorders. The hyper-proliferative disorders are selected from the group consisting of cancers of the breast, respiratory tract, brain, reproductive organs, digestive tract, urinary tract, eye, liver, skin, head and neck, thyroid, parathyroid and their distant metastases.

In certain embodiments, a polypeptide as described herein is used in the preparation of a medicament for the treatment of a disease in a subject. In certain embodiments, said disease is cancer.

In certain embodiments is a method of treating a disease in a subject, comprising administering to said subject in need thereof one or more therapeutically effective doses of a pharmaceutical composition or a pharmaceutical combination.

In one embodiment the disease is cancer. In certain embodiments the cancer is selected from the group consisting of glioblastoma, melanoma, cholangio carcinoma, small cell lung cancer, colorectal cancer, prostate cancer, vaginal cancer, angiosarcoma, non-small cell lung cancer, appendiceal cancer, squamous cell cancer, salivary duct carcinoma, adenoid cystic carcinoma, small intestine cancer, and gallbladder cancer.

Provided herein is a method of treating a disease in a subject, comprising administering to said subject in need thereof one or more therapeutically effective doses of a pharmaceutical composition of as above. In certain embodiments, the pharmaceutical composition is administered to the subject as one or more therapeutically effective doses administered during a therapeutically effective course of treatment. In certain embodiments, the dose is administered to a human or animal by any clinically appropriate route and formulation. In certain embodiments, the subject is a mouse, rat, monkey, or human.

Also provided herein is a nucleic acid comprising a polynucleotide sequence encoding a polypeptide as described herein; or a reverse complement of said polynucleotide sequence thereof. Further provided herein is an expression vector comprising said polynucleotide sequence of as described herein and a recombinant regulatory sequence operably linked to said polynucleotide sequence. Provided herein is a host cell, comprising said expression vector. In certain embodiments, the host cell is a prokaryote. In certain embodiments, the host cell is *E. coli*. In certain embodiments, the host cell is a mammalian cell.

Additional aspects and advantages of the present disclosure will become readily apparent to those skilled in this art from the following detailed description, wherein only illustrative embodiments of the present disclosure are shown and described. As will be realized, the present disclosure is capable of other and different embodiments, and its several details are capable of modifications in various obvious respects, all without departing from the disclosure. Accordingly, the drawings and description are to be regarded as illustrative in nature, and not as restrictive.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

Various features of this disclosure are set forth with particularity in the appended claims. A better understanding of the features and advantages of the present disclosure will be obtained by reference to the following detailed description that sets forth illustrative embodiments, in which the principles of the invention are utilized, and the accompanying drawings of which:

As illustrated in FIG. 1 using the full-length XPAT, each XTEN has a proximal end and a distal end, wherein the proximal end is positioned, relative to the distal end, closer to the biologically active polypeptide (e.g., T-cell engager, cytokine, monoclonal antibody (mAb), antibody fragment, or other protein that is XTENylated).

FIG. 4A demonstrates that a barcoded XTEN (bottom panel) can be constructed by replacing a sequence motif in a general-purpose XTEN (top panel) (e.g., the third sequence motif from the N-terminus, "D") with a barcode-generating motif, "X"; and, in this example, the barcode-generating motif ("X") is itself the unique proteolytically-cleavable barcode sequence. As shown in the bottom panel in FIG. 4A, the barcode is positioned such that all the severe truncation forms of the XTEN lack the barcode, and all the limited truncation forms of the XTEN contain the barcode. FIG. 4B illustrates the relative abundance of various cleavage products in two different mixtures of XPAT. In one of the mixtures, the barcode is present in 99% of the constructs that contain the biologically active protein. In the other one of the mixtures, 13% of the constructs are lack a barcode (e.g., due to truncation). FIGS. 4A-4B illustrate the use of barcoded XTEN to differentiate between two polypeptide mixtures having substantially similar average molecular weights but discernibly different pharmacological activities.

FIGS. 5A-5B illustrate effective masking by XTENs on XTENylated Protease-Activated T-cell engagers ("XPATs") in general, and on HER2-XPATs in particular. For example, cytotoxicity of the XTENylated (masked) HER2-XPAT (e.g., set forth in Table D) and the corresponding de-XTENylated (unmasked, activated) HER2-PAT against two different HER2-expressing (e.g., cancer) cell lines was observed in a dose-dependent manner. The unmasked, de-XTENylated PAT (indicated as solid circles) yielded EC50 values of 3.4 picomolar (pM) (SKOV3 cells) (FIG. 5A) and 4.8 pM (BT474 cells) (FIG. 5B) respectively, while the corresponding masked, XTENylated PAT (indicated as solid squares) yielded EC50 values of 44,474 pM (SKOV3 cells) and 49,370 pM (BT474 cells), indicating a masking effect of at least $10^4$-fold.

FIG. 6A depicts effective masking by XTENs on a bispecific T-cell engager when in contact with non-cancerous tissue (cardiomyocytes). More particularly, FIG. 6A shows the cytotoxicity of the XTENylated (masked) HER2-XPAT (e.g., set forth in Table D) and the corresponding de-XTENylated (unmasked, activated) HER2-PAT against cardiomyocytes. Killing of the cardiomyocytes by T cell-directed cytolysis in response to unmasked, de-XTENylated PAT was observed (with an approximate EC50 concentration of 64 pM), while in contrast to tumor cells, the cardiomyocytes remained refractory to killing by masked, XTENylated PAT at concentrations as high as 1 micromolar (pM).

FIGS. 6B-6C illustrate robust masking by XTENs on bispecific T-cell engagers in the context of engaging target cells with relatively medium or low levels of target antigen expression. For example, FIG. 6B illustrates cytotoxic effects of XTENylated and de-XTENylated Protease-Activated T-cell engagers (PATs) on a cancer cell line with low level of HER2 expression, MCF-7, where masking with XTEN polypeptides reduced T cell-mediated cytotoxicity of the tested HER2-XPAT by approximately $10^4$-fold. As another example, cytotoxicity of the XTENylated (masked) HER2-XPAT and the corresponding de-XTENylated (unmasked, activated) HER2-PAT against MDA-MB-453, another cancer cell line with a medium level of HER2 expression, was determined (FIG. 6C).

FIG. 7A illustrates comparable efficacy induced with equimolar dosing of a cleavable XTENylated HER2 T-cell engager ("HER2-XPAT," indicated as hexagons) and a corresponding unmasked HER2 T-cell engager ("HER2-PAT," indicated as triangles) in (e.g., BT-474) tumor-bearing mice. (** indicates $p<0.01$.) Notably, between the two tested XTENylated bispecifics, tumor regression was observed on the cleavable XTENylated construct (indicated as hexagons) but not on the non-cleavable XTENylated counterpart (indicated as diamonds), indicating that proteolytic unmasking (de-XTENylation) is a prerequisite for efficacy. FIG. 7B illustrates efficacy of cleavable XTENylated bispecific (e.g., HER2-XPAT) against large tumors with a single dose (e.g., 2.1 milligrams per kilograms (mpk)). The non-cleavable constructs used in the experiments are identical to the corresponding cleavable constructs, but the release site has been replaced with a non-cleavable sequence of similar length made from GASTEP amino acids (glycine, alanine, serine, threonine, glutamate, and/or proline). FIG. 7C shows efficacy of the masked HER2-XPAT (solid triangles) at two different concentrations (15 nmol/Kg and 36 nmol/Kg), compared to unmasked HER2-PAT (solid squares) and non-cleavable XPAT (solid diamonds). The data for the tumors treated with vehicle and vehicle+PBMCs is also shown. FIG. 7D shows the percentage cleavage of HER2-PAT in vivo in BT-474 tumor bearing mice.

FIG. 9A illustrates stability of XTENylated Protease-Activated T-cell engagers (PATs) in plasma circulation in subjects (e.g., cynomolgus monkey) (e.g., at 25 mg/kg dose). Lack of significant increase in XTENylated PAT clearance relative to its non-cleavable form indicates minimal cleavage in periphery. Comparable pharmacokinetics were observed between the tested cleavable HER2-XPAT (solid triangle and solid square) and the non-cleavable counterpart (unfilled triangle and unfilled square). The non-cleavable constructs used in the experiments are identical to the corresponding cleavable constructs, but the release site has been replaced with a non-cleavable sequence of similar length made from GASTEP amino acids (glycine, alanine, serine, threonine, glutamate, and/or proline). FIG. 9B shows that there is a low frequency of HER2-XPAT proteolytic metabolites in circulation even 96 hours post administration.

FIG. 10A shows a single dose, single subject HER2-XPAT dose escalation and demonstrates that all doses up to 42 mg/kg were tolerated. FIG. 10B shows a single subject HER2-PAT de-escalation scheme in which the maximum tolerated dose of the unmasked HER2-PAT is 0.2 mg/kg. FIG. 10C shows the plasma concentrations of masked HER2-PAT (at a 450-fold higher tolerated Cmax) as compared to unmasked HER2-PAT.

FIGS. 11A and 11B show peripheral T cell Activation data that show there is no peripheral T cell activation in response to HER2-XPAT as compared to HER2-PAT. FIGS. 11C-11E show the levels of cytokines IL-6 (FIG. 11C), TNF-α (FIG. 11D) and IFN-γ (FIG. 11E)

in subjects treated with HER2-XPAT and HER2-PAT at varying concentrations, demonstrating that HER2-XPAT does not induce cytokine release even at 50 mg/kg. Note, that the normal range for cytokine levels: IL-6≤6 pg/ml, TNFα 1-10 pg/ml, IFNγ≤10 pg/ml.

Figure 12:
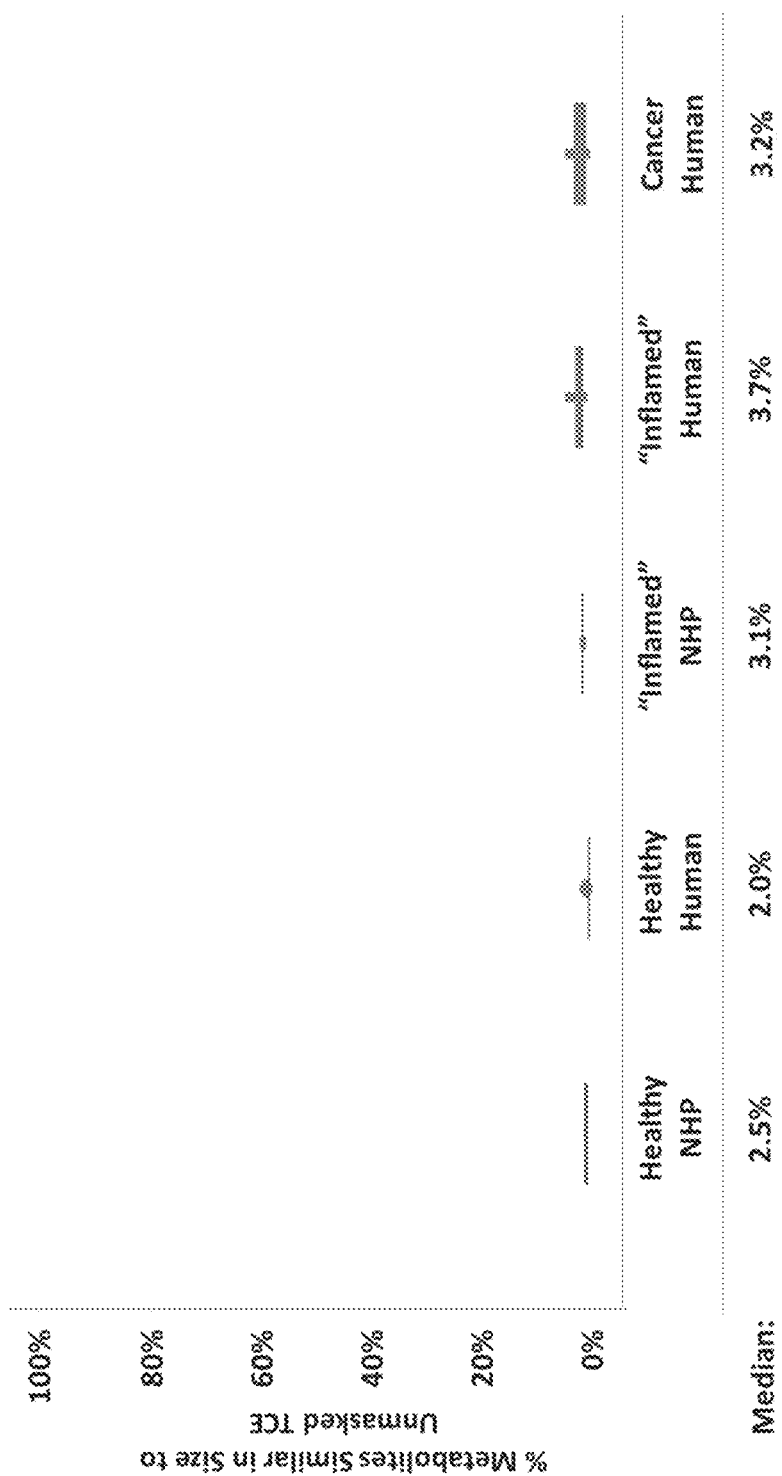

FIG. 12. AMX-818 Incubated ex vivo in plasma samples from NHPs and humans showed minimal cleavage to unmasked TCE, even under inflammatory conditions. AMX-818 with a fluorescent label (DyL650) attached to the tandem scFv was incubated in the indicated plasma samples for seven days at 37° C. Samples were then run on a gel and metabolites similar in size to the unmasked, active form of AMX-818 were quantified using a LI-COR detector. Inflammatory disease human samples were derived from patients with rheumatoid arthritis, lupus, inflammatory bowel disease, and multiple sclerosis. Cancer human samples were derived from patients with lung, breast, and colon tumors. Sample sizes: Healthy NHP N=4, Healthy Human N=4, "Inflamed" NHP N=6, "Inflamed" Human N=27, Cancer Human N=11.

Figure 13A:
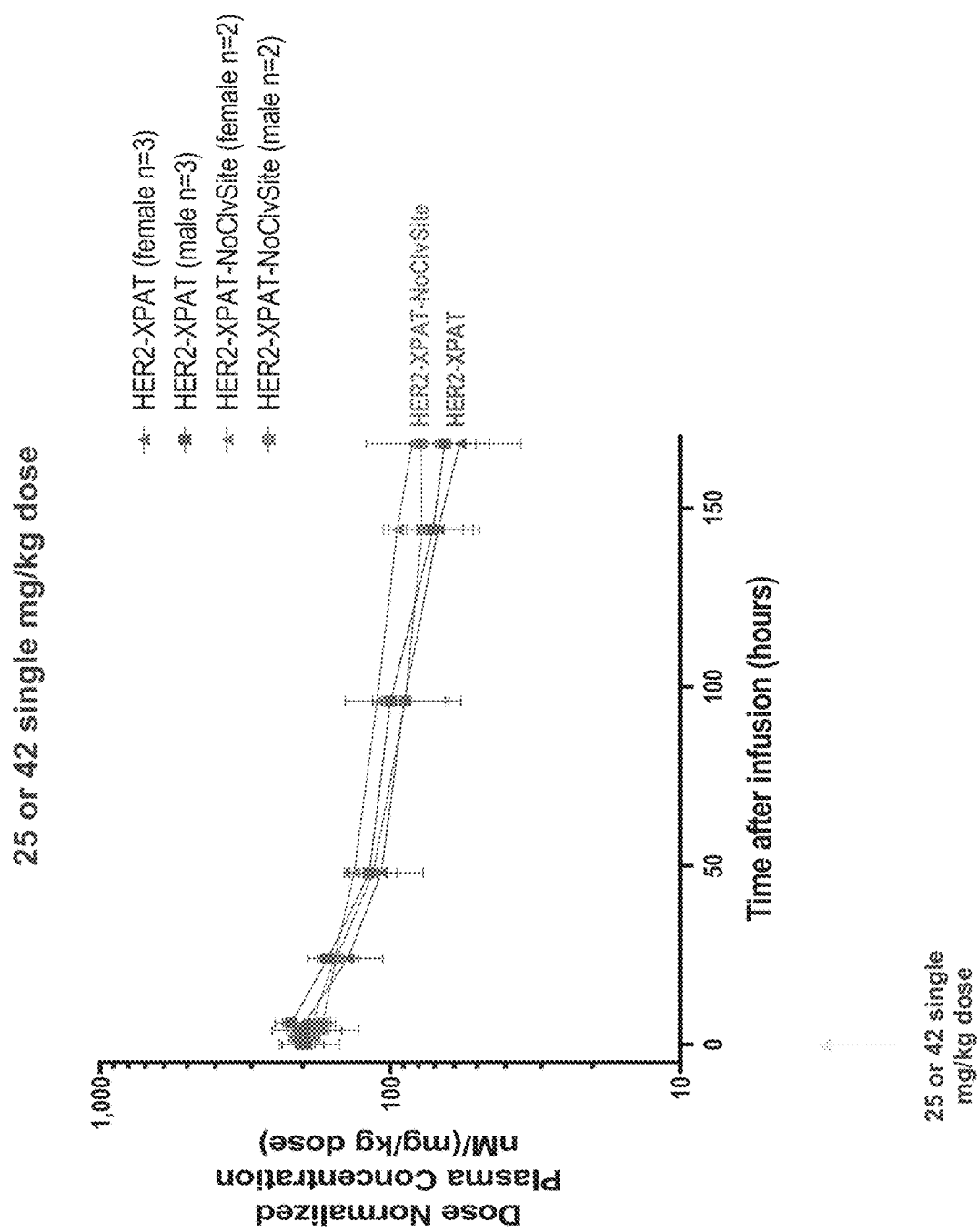
Figure 13B:
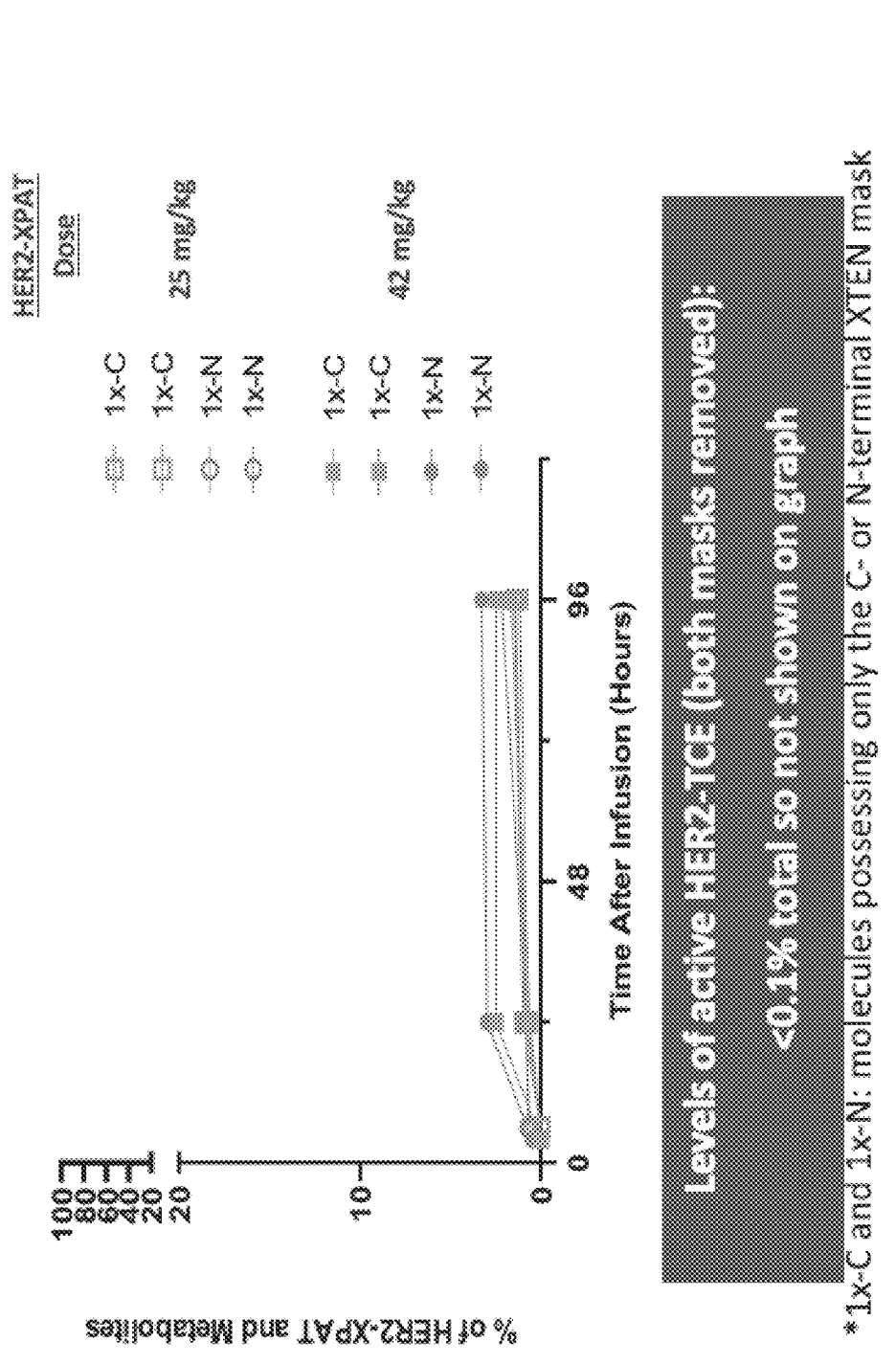

FIG. 13A-FIG. 13B. Provides additional data in support of the safety profile of a preferred HER2-XPAT of the present invention. The data in FIG. 13A shows a comparable PK between HER2-XPAT and the non-cleavable HER2-PAT formats, demonstrating that the protease release site remains largely stable in circulation of cynomolgus monkeys even at high doses. FIG. 13B shows that even at high dose of HER2 XPAT there is very limited systemic accumulation of metabolites lacking one or both XTEN masks.

Figure 14A:
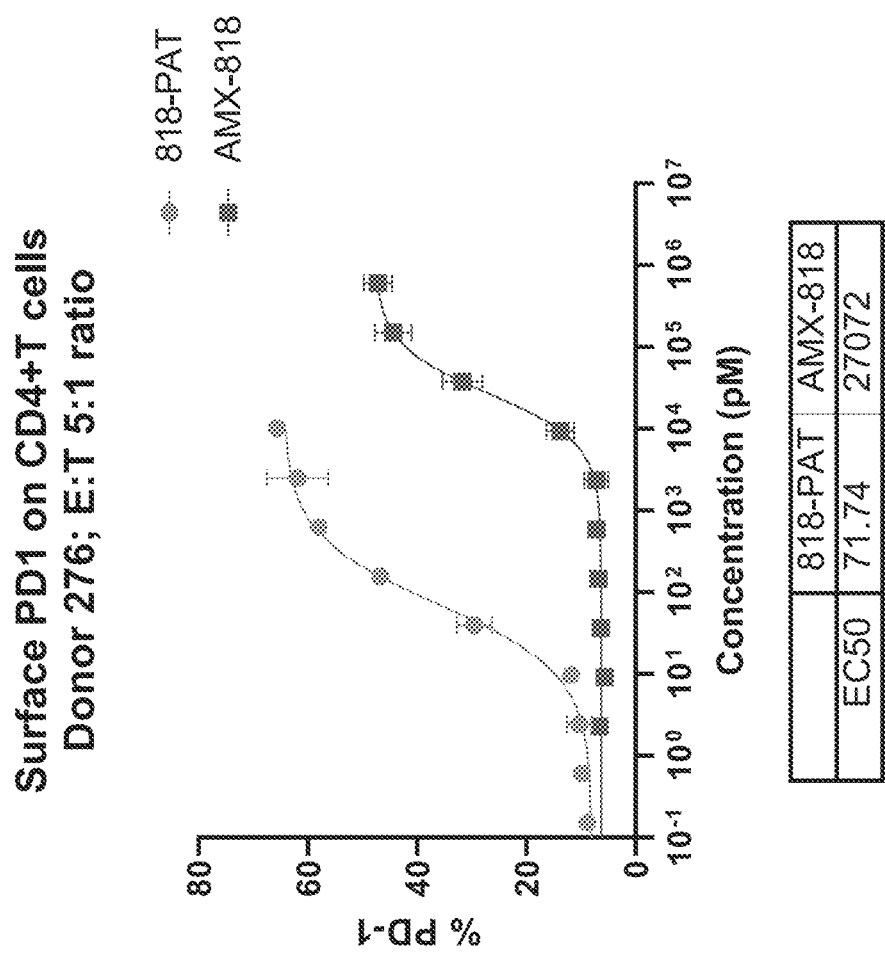
Figure 14B:
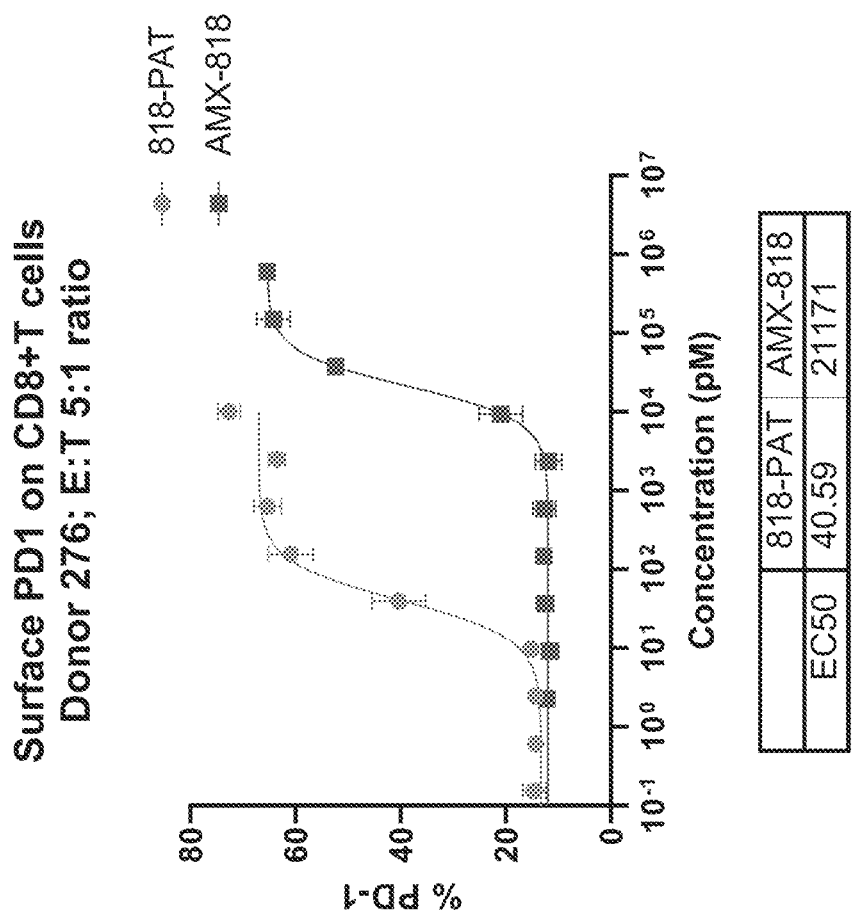
Figure 14C:
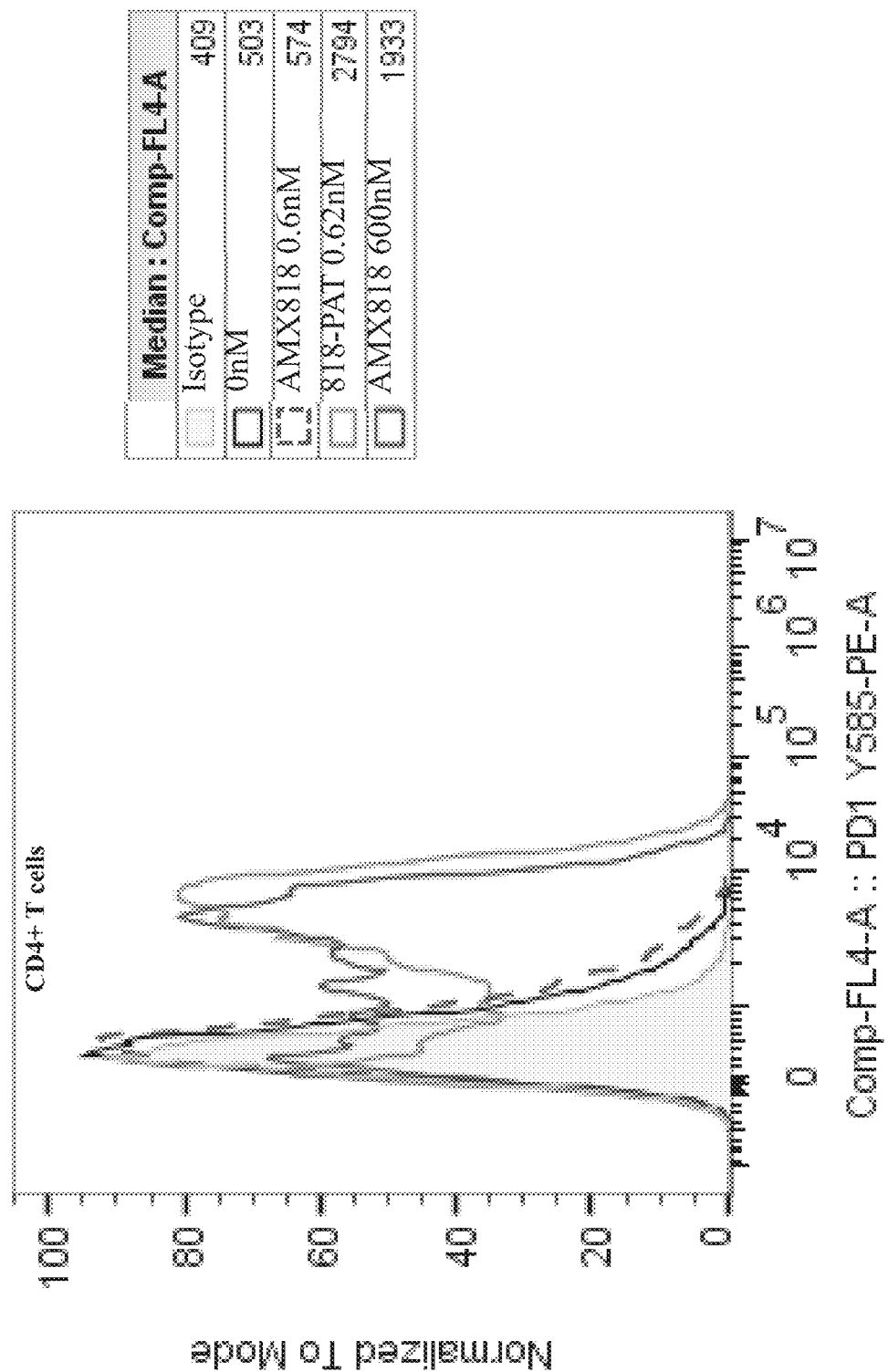
Figure 14D:
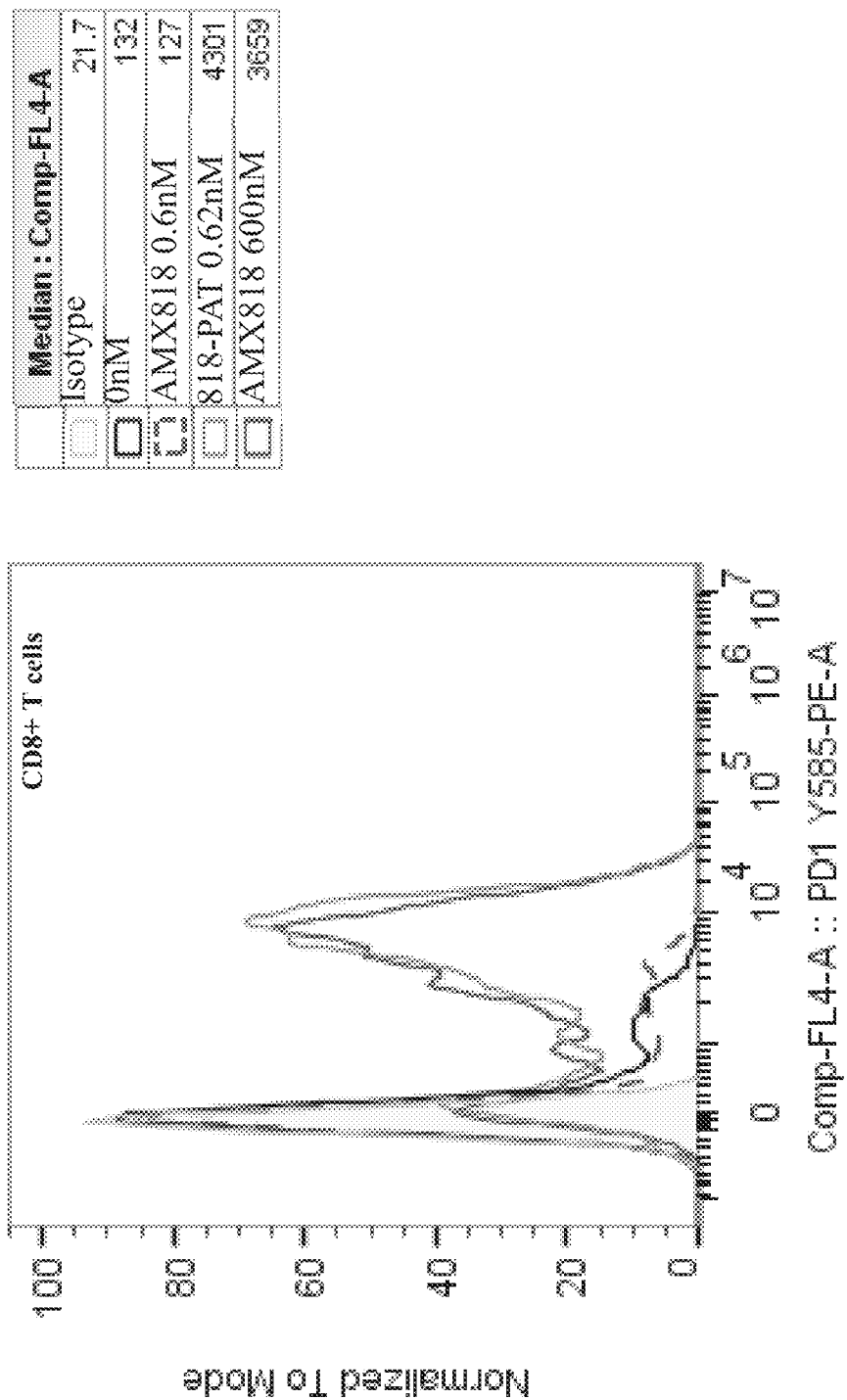

FIGS. 14A-14D. AMX818 and 818-PAT Induce Surface Expression of PD-1 on T cells in Response to SKOV3 Tumor Cells. Surface PD-1 expression was evaluated on CD4+ and CD8+ T cells by flow cytometry following a 48-hour co-incubation of PBMCs and SKOV3 cells at a 5:1 Effector:Target ratio with test articles at the indicated concentrations. FIG. 14A and FIG. 14C shows surface PD1 expression on CD4+ T cells in the presence of AMX818 and 818-PAT. FIG. 14B and FIG. 14D shows surface PD1 expression on CD8+ T cells in the presence of AMX818 and 818-PAT.

Figure 15A:
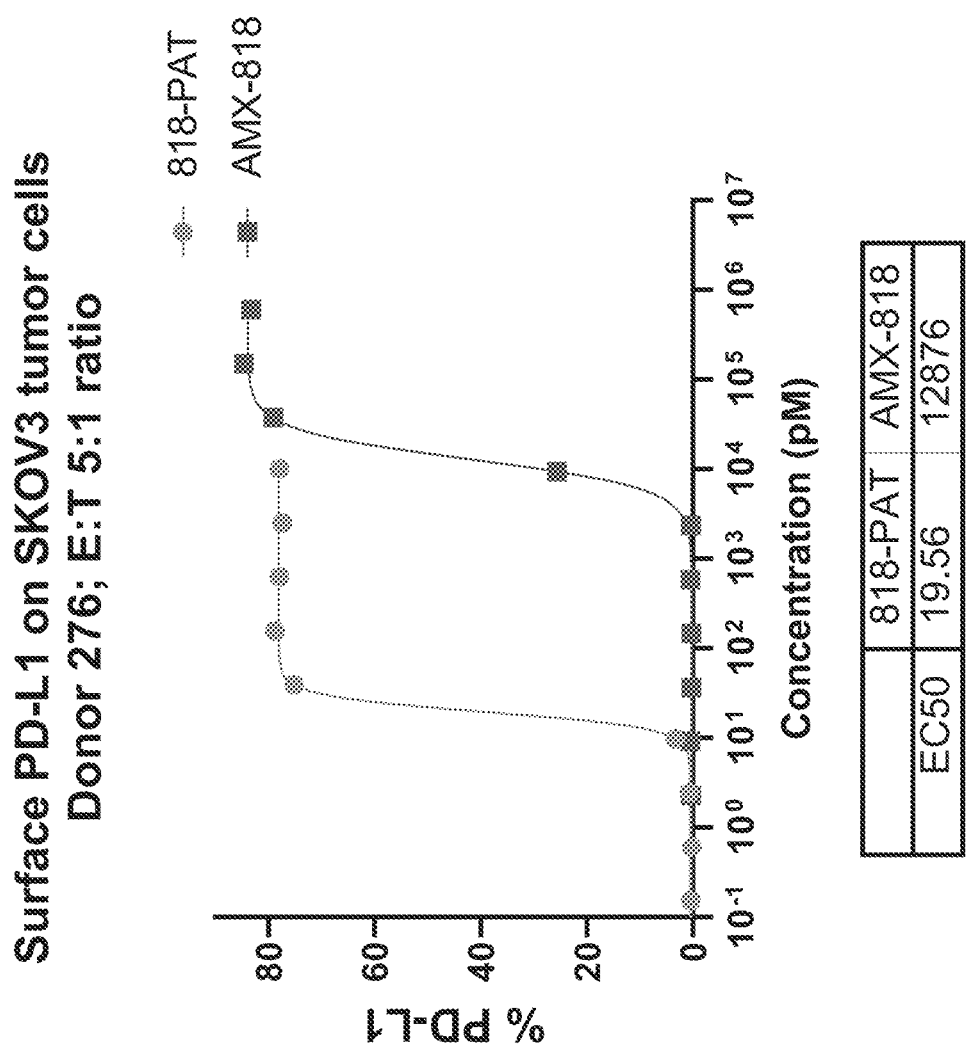
Figure 15B:
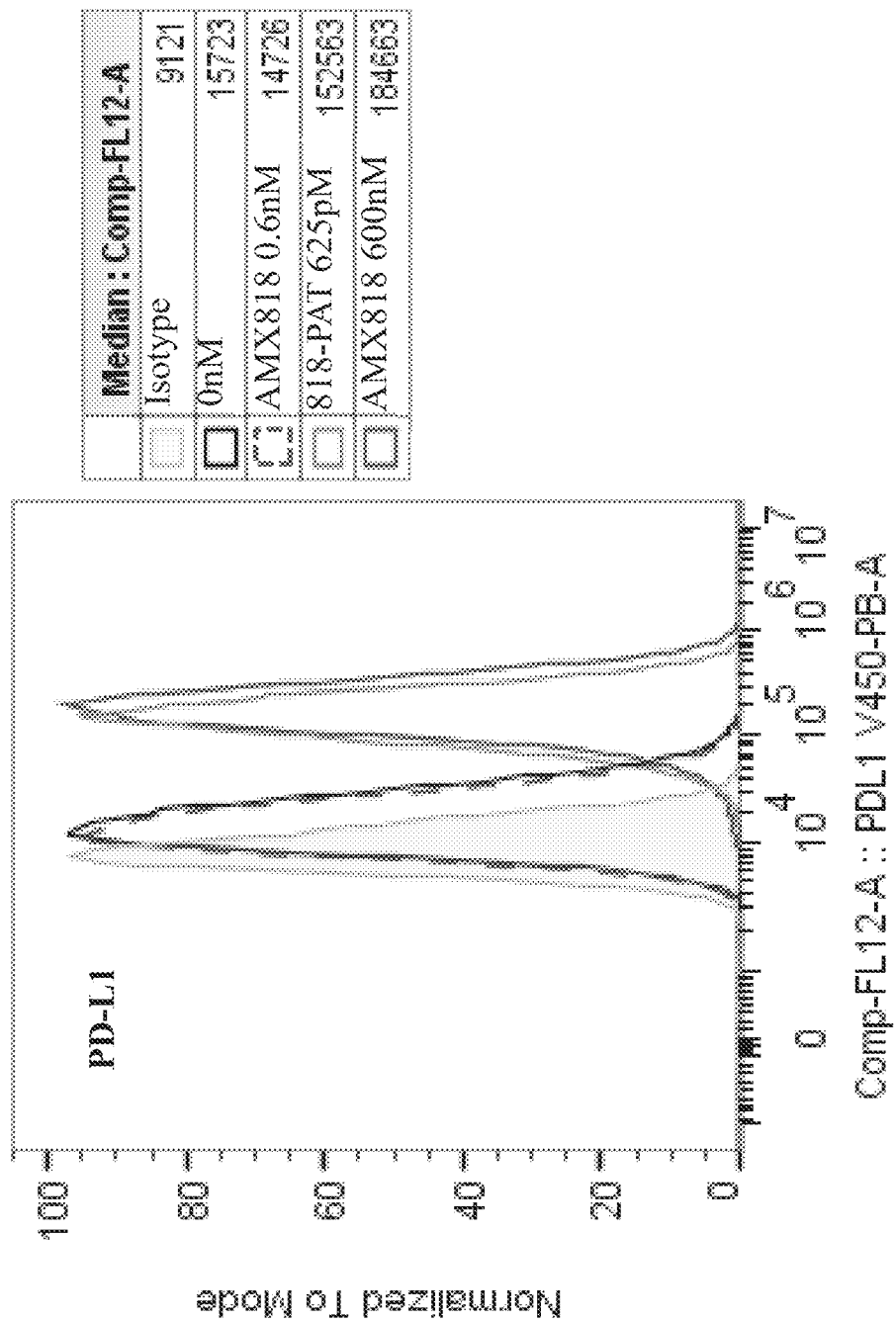
Figure 15C:
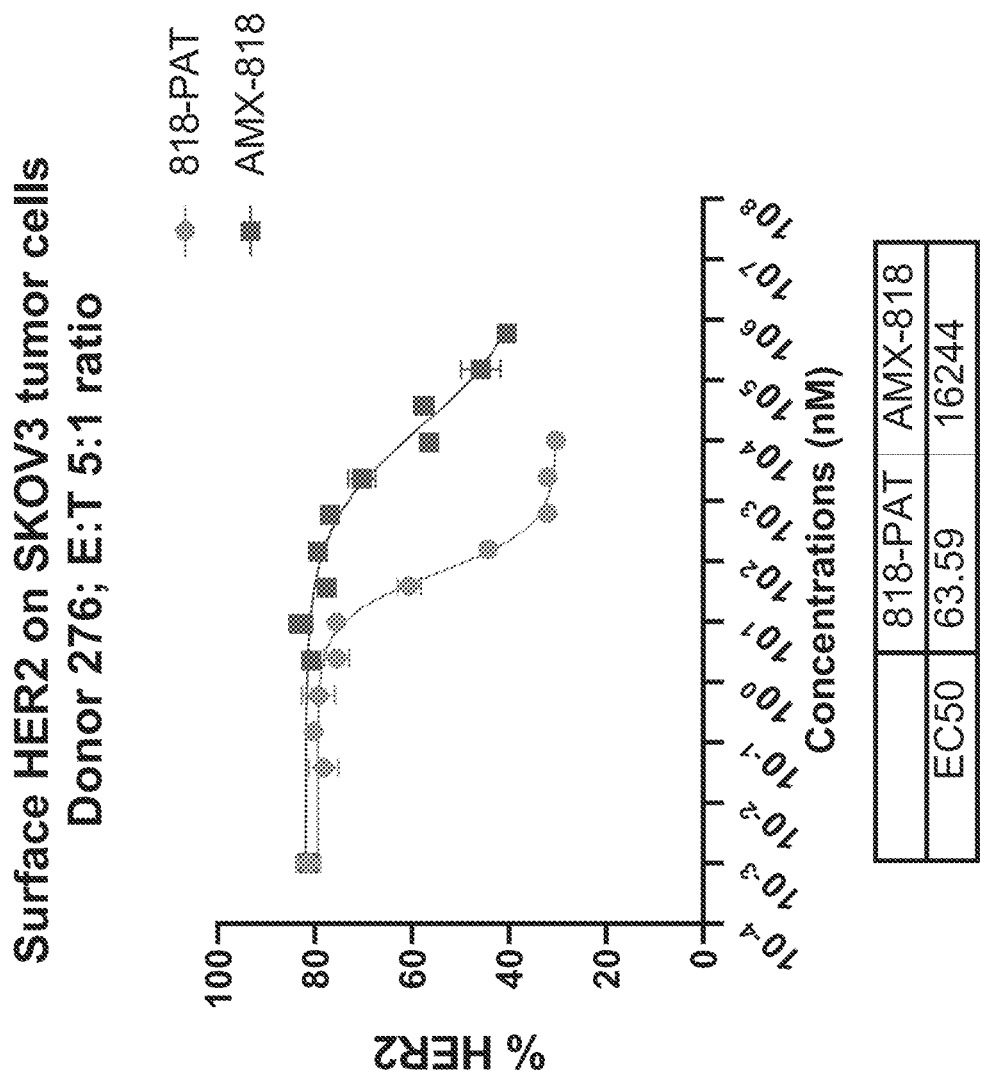

FIG. 15A-15C. AMIX818 and 818-PAT Induce Surface Expression of PD-L1 on T cells in Response to SKOV3 Tumor Cells. FIG. 15A and FIG. 15B show PD-L1 expression on SKOV3 cells at a 5:1 Effector:Target ratio with test articles at the indicated concentrations. FIG. 15C shows surface HER2 expression on SKOV3 tumor cells.

Figure 16A:
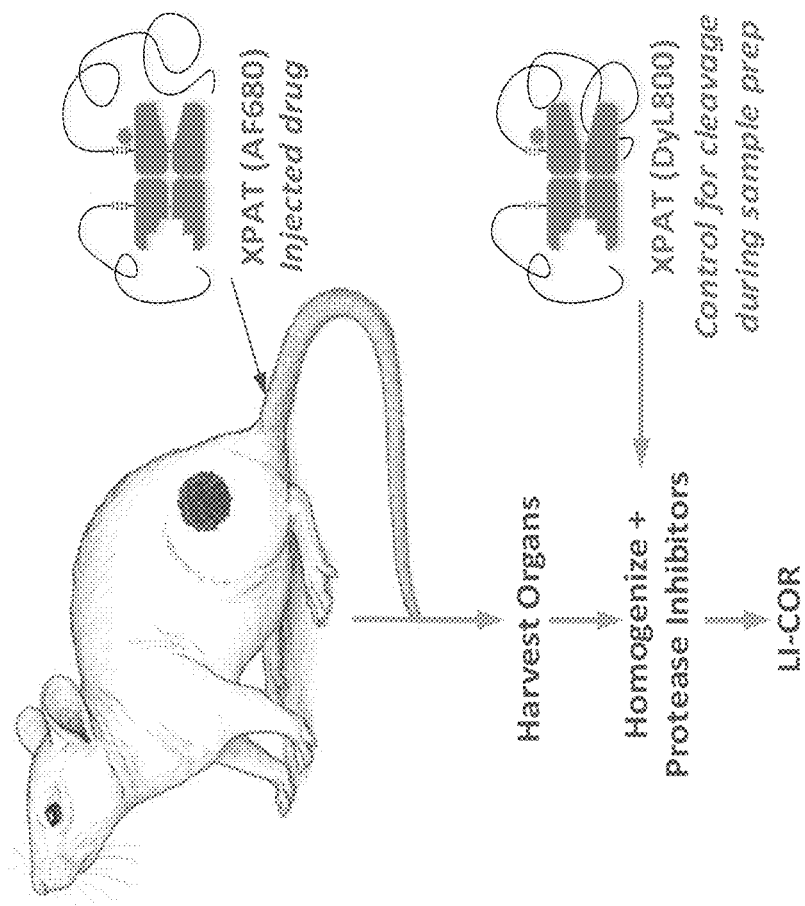
Figure 16B:
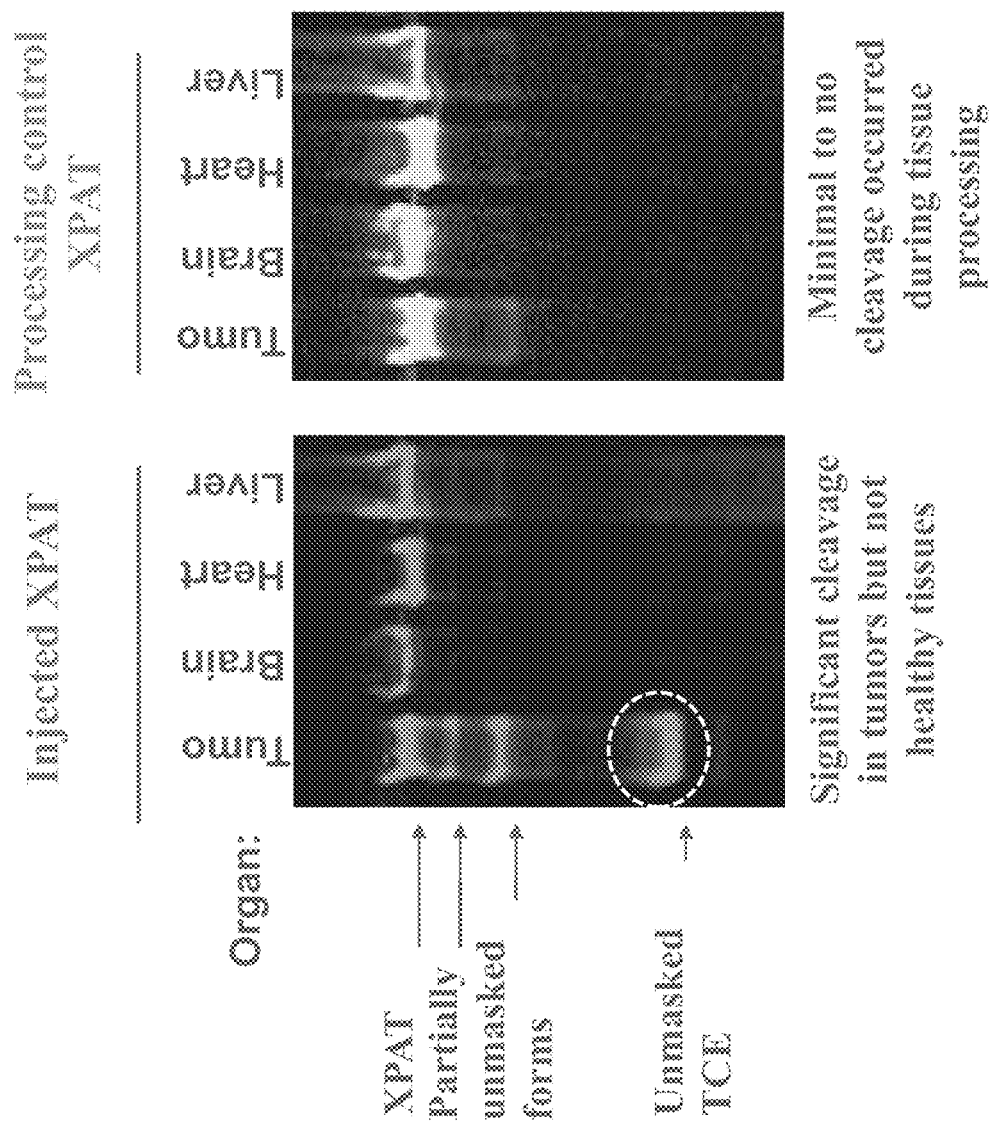
Figure 16C:
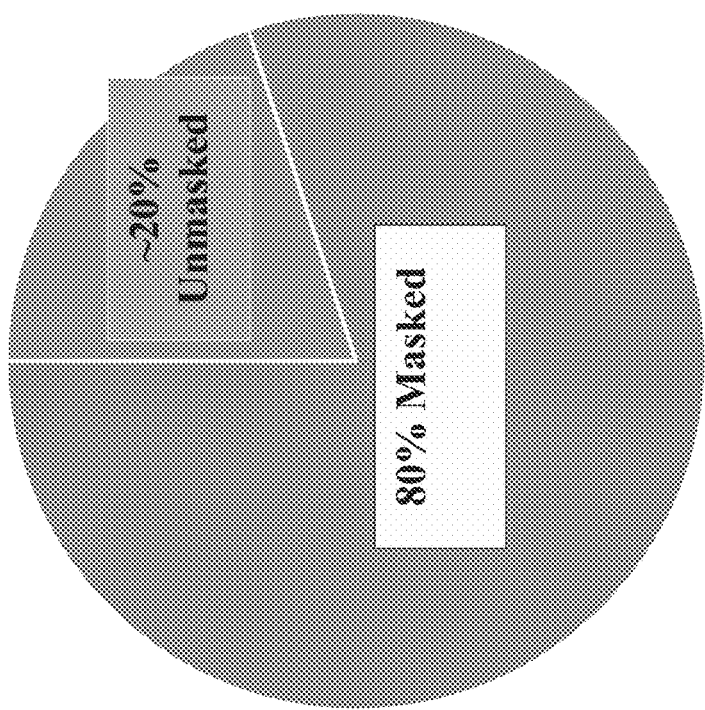

FIG. 16A-16C. XPATs Are Preferentially Cleaved to Unmasked TCEs in Human Tumors Implanted in Living Mice, with Minimal Cleavage Observed in Healthy Tissues. A single dose of 1.8 mg/kg (13 nM) red fluorophore-labeled (Alexa) XPAT was injected into mice implanted with human tumors (FIG. 16A). Two days later, tumors and healthy organs were harvested to measure protease cleavage in vivo (results shown in FIG. 16B). The green-fluorophore-labeled (Dyl800) XPAT was added post-tissue harvesting in the presence of protease inhibitors to account for artifactual cleavage that could result from release of non-relevant intracellular proteases during the processing. By comparing the generated cleavage products of both red and green fluorophore-labeled XPATs, we can determine the cleavage that occurred in the various tissues in vivo vs artifactually during tissue processing. On average 20% of XPAT in the tumor is activated by Day 2 after injection into mice implanted with tumors (n=31 across 9 tumor types; FIG. 16C).

DETAILED DESCRIPTION OF PREFERRED EMBODIMENTS

There is a significant unmet need in cancer therapeutics. While TCEs have been shown to be effective in inducing remission in certain cancers, they have not produced widespread therapeutics due to their extreme potency and on target, off tumor toxicities in healthy tissues. By way of explanation, the TCEs form a bridge between T cells and tumor cells and activate T cell-mediated of the tumor cell and further initiating a cytokine amplification cascades that promotes further killing and potentially provides long term immunity. T cells activated by TCEs to release cytolytic perforin/granzymes in a manner that is independent of antigen-MHC recognition. This creates a two-fold response: direct tumor cell death and amplification of tumor killing through initiation of a powerful cytokine response from the tumor cells. The direct tumor cell death results in release of tumor antigens. The cytokine response includes, among others, increased interferon-γ which stimulates CD8 T cell activity and stimulates antigen presentation by APCs; increased IL2 which causes increased proliferation of activated T-cells, and increased CXCL9 and 10 response which increases T cell recruitment. Together the release of tumor antigens and the initiation of the cytokine response results in activation of the endogenous T-cell response which potentially cases epitope spreading to induce long term immunity.

The toxicity challenge with TCEs arises out the fact that most tumor targets are, to some extent, also expressed in healthy tissue, and normal cells also can produce the cytokines response resulting in cytokine release syndrome (CRS). These two powerful responses of health tissue to T cell activation by TCEs results in an overall lack therapeutic index for these agents.

The present invention overcomes the drawbacks in the existing TCEs by providing a conditionally-activated TCE, XPAT or XTENylated Protease-Activated bispecific T Cell Engager targeting HER2 (referred to herein as HER2-XPAT, and exemplified as AMX818). More particularly, the XPAT of the present invention exploits the dysregulated protease activity present in tumors vs. healthy tissues, enabling expansion of the therapeutic index. The XPAT core consists of 2 single chain antibody fragments (scFvs) targeting CD3 and the tumor target (in exemplary embodiments the tumor target is HER2). Two unstructured polypeptide masks (XTENs) are attached to the core that sterically reduce target engagement of either the tumor target and/or CD3 and extend protein half-life. The properties of the XTEN polymer also minimize the potential for immunogenicity, as its lack of stable tertiary structure disfavors antibody binding and the absence of hydrophobic, aromatic and positively charged residues that serve as anchor residues for peptide MHC II binding reduces the potential for T cell epitopes. In humans, minimal immunogenicity of XTEN polymers was observed in >200 patients treated with drugs containing XTEN in the context of half-life extended forms of human growth hormone and Factor VIII. Protease cleavage sites at the base of the XTEN masks enable proteolytic activation of XPAT in the tumor microenvironment, unleashing a small, highly potent TCE that is capable redirecting cytotoxic T cells to kill target-expressing tumor cells. In healthy tissues, where protease activity is tightly regulated, XPATs should remain predominantly inactive as intact prodrugs, thus expanding the therapeutic index compared to unmasked TCEs.

In addition to localized activation, the short half-life of the unmasked PAT form should further widen the therapeutic index while providing the potency of T-cell immunity to improve the eradication of solid tumors. The release sites used in the XPATs can be cleaved across a broad array of tumors by proteases that are collectively involved in every cancer hallmark (growth; survival and death; angiogenesis; invasion and metastasis; inflammation; and immune evasion). Thus, TCE activity of the XPATs is localized to tumors by exploiting the enhanced protease activity that is upregulated in all stages of cancer and tumor development but is tightly regulated in healthy tissues.

The components of the exemplary HER2-XPAT, AMX-818, have been optimized to achieve the desired balance between providing sufficient protection in healthy tissue while retaining the necessary potency in tumors across a broad range of cancers. To reduce the potential for T cell activation by the prodrug, a lower binding affinity was selected for the a-CD3 domain in addition to a longer XTEN polymer mask (576 amino acid mask vs 256 amino acids on the HER2 side). To ensure sufficient activation of AMX-818 in the tumor, the protease release site at the base of the XTEN masks was engineered to be cleaved by at least 8 different proteases among 3 different classes that have been reported to be over-expressed or dysregulated in cancer; these include several matrix metalloproteinases (MMPs), Matriptase, uPA, and the cysteine protease, legumain. As a safety checkpoint, co-engagement of both CD3 and HER2 by AMX-818 is required for T cell activation. Activation of T cells should not occur if AMX-818 is unmasked in inflamed tissues where HER2 expression is absent or if it encounters HER2 expressed in healthy tissue where proteases are tightly controlled. This AND-gate feature is expected to provide preferential activation in the tumor where both elevated protease activity and high HER2 expression are present.

Thus presence of the XTEN on the XPAT produces an agent that a long half-life, weak target engagement and negligible T-cell activation. Once the XTEN is removed by the action of the proteases in the tumor microenvironment, this preferential activation of the XPATs produces an activated drug (PAT, without the XTEN) that has a short half-life, optimal target engagement, and highly efficient T-cell activation, thereby producing a powerful activated drug with an enhanced therapeutic index. The HER2-XPATs of the present invention a capable of improving the toxicity profile of T cell engagers while maintaining their potency against solid tumors, thus enabling a significant increase in the therapeutic index and expansion of target landscape for this potent modality.

Summary of Data Generated from AMX-818, an Exemplary HER2-XPAT

Target binding and in vitro biological activities of AMX-818 have been characterized in multiple studies. Equilibrium binding analysis utilizing surface plasmon resonance demonstrated highly comparable affinities for AMX-818 and its metabolites between human and cynomolgus monkey HER2 and CD3, supporting the use of cynomolgus monkey as a species for toxicity and PK studies. Proteolytically-activated AMX-818(PAT) bound to human and cynomolgus monkey HER2 with 2.4 nM and 2.0 nM affinities, respectively, and to human and cynomolgus monkey CD3 with 26.3 nM and 21.5 nM affinities, respectively. Masking of AMX-818 reduced its affinities to HER2 by 10-fold and to CD3 by approximately 6-fold for both species. AMX-818 bound to human and cynomolgus monkey HER2 with 24.9 nM and 20.1 nM affinities, while CD3 affinities for human and cynomolgus monkey were 160 nM and 140.3 nM, respectively.

The activity of a TCE depends on its ability to activate T cells through effective stimulation of the T cell receptor (TCR). The extreme potency of TCEs derives from the minimal requirement for as few as 3 TCRs to become stimulated and coalesce to form an immune synapse between the T cell and target cell to initiate cytotoxicity. While T-cell engagers are primarily known for inducing cytotoxicity, their potency also involves cytokine-driven actions downstream of T-cell activation that enhance and amplify the anti-tumor immune response. T-cell activation by AMX-818, its prototype AMX-818-P1, and its proteolytic metabolites was characterized in vitro utilizing a Jurkat NFAT-reporter cell and primary human PBMCs in the presence of HER2-high-expressing tumor cells, BT-474 (breast) and SKOV-3 (ovarian). Human T cells were also assessed for upregulation of the surface activation marker CD69 and the inhibitory receptor PD-1 by flow cytometry. As an indirect measure of T-cell activation, upregulation of the PD-1 ligand PD-L1 was assessed on the surface of SKOV3 tumor targets, as it is induced in response to IFN-γ secreted by activated T cells.

AMX-818(PAT) activated the Jurkat NFAT-Luciferase reporter T cells in the presence of BT-474 cells with $EC_{50}$ values in the 70 pM range while response to the masked AMX-818 and AMX-818-P1 was significantly attenuated by 4 orders of magnitude, with maximal responses reduced by 80-90% compared to that of the activated AMX-818(PAT). T-cell activation by AMX-818(PAT) was not observed in the absence of HER2+BT-474 tumor cells, demonstrating that monovalent engagement of CD3 was not sufficient for activation and that co-engagement of both CD3 and tumor target were required for effective T cell receptor (TCR) stimulation. The singly masked AMX-818 metabolites, AMX-818(1x-C), and AMX-818(1x-N) demonstrated intermediate activity. AMX-818-NoClvSite induced no detectable T-cell activation, suggesting that the minimal response observed by the AMX-818 was likely driven by proteolytic cleavage.

AMX-818(PAT) and prodrug AMX-818 induced CD69 and PD-1 expression on the surface of both CD4+ and CD8+ T-cell subsets and PD-L1 on SKOV3 tumor cells to comparable degrees. However, the dose-response curve for AMX-818 was shifted on average 400 to 650-fold higher relative to that of AMX-818(PAT), further demonstrating effective functional masking of the XTEN masks on AMX-818.

AMX-818 and its metabolites were characterized for their cytotoxic activity and induction of inflammatory cytokines. Peripheral blood mononuclear cells (PBMCs) were used as effector cells and the HER2-high BT-747 breast tumor line selected as the tumor target cell. Because cardiac tissues are known to express HER2 and, while rare, cardiac toxicities have been observed in patients treated with some HER2-targeted therapies, primary cardiomyocytes (HER2 low to medium) were selected to represent a more physiologic cytolytic target for AMX-818 and its proteolytic metabolites. A luminescence-based cytotoxicity assay was conducted at a 1:1 effector:target cell ratio and cell free supernatants were collected for measurement of TCE-induced cytokines.

AMX-818(PAT) demonstrated highly potent cytotoxicity against BT-474 tumor cells, showing nearly complete target cell killing with half-maximal inhibitory concentration ($IC_{50}$) values in the 5-11 pM range. With lower HER2-expressing human cardiomyocytes as targets—cells not expected to exhibit dysregulated protease activity—cytotoxicity responses were reduced by approximately 13-fold and maximal killing was incomplete, approaching only 50-60%. The cytotoxic response by AMX-818 against both BT-474 and cardiomyocyte cells was strongly attenuated, with average $IC_{50}$ values shifted by 2500- to 3000-fold, demonstrating effective functional masking of the prodrug by its XTEN polymer masks. The masks provide synergistic protection in cytotoxicity well above their combined impact on reducing target binding by impeding formation of the functional immune synapse that is required to initiate target cell killing. AMX-818 and its prototype AMX-818-P1 showed comparable cytotoxicity consistent with their nearly identical composition. Cytotoxicity of the singly masked proteolytic metabolites, AMX-818(1x-N) and AMX-818(1x-C) was intermediate between AMX-818(PAT) and AMX-818, demonstrating partial protection by a single mask. The cytotoxicity observed by AMX-818 was likely due to proteolytic cleavage based on the further reduction in activity provided by AMX-818-NoClvSite, the format lacking both protease cleavage sites.

In general, the relative potencies of AMX-818 and its metabolites in induction of cytokine secretion in supernatants from cytotoxicity assays mirrored those observed in cytotoxicity to both BT-474 and cardiomyocyte target cells (where AMX-818(PAT) was most potent>singly masked forms>and AMX-818 least potent). The cytokine $IC_{50}$ values were on average higher than those for the cytotoxic response demonstrating that cytotoxicity is the more sensitive assay among the two. Responses to AMX-818 in the presence of both BT-474 and cardiomyocytes were reduced by several orders of magnitude relative to those of AMX-818(PAT), while the singly masked metabolites AMX-818 (1x-N) and AMX-818(1x-C) showed intermediate response.

In the presence of cardiomyocytes, the maximal levels of cytokines induced by AMX-818 at its highest concentration tested (300 nM) were markedly reduced relative to those induced by AMX-818(PAT), with the exception of IL-6. In the presence of both BT-474 and cardiomyocytes, elevated IL-6 levels were detected at 300 nM concentrations of both AMX-818 and AMX-818-NoClvSite, that in most cases exceeded the maximal levels produced by AMX-818(PAT) by 2- to 6-fold. Of note, this is in contrast to what is observed in vivo in cynomolgus monkeys, where peak systemic levels of IL-6 are >9-fold higher at the 0.2 mg/kg MTD of AMX-818(PAT) than at the 42 mg/kg MTD of AMX-818.

In assessing the induction of cytokines in the absence of HER2-expressing target cells, cytokines IL-2, IL-4, TNF-α, and IFN-γ were not induced in human PBMC cultures treated with suspension and plate-coated AMX-818 or AMX-818(PAT). At its highest concentration tested (500 nM), soluble AMX-818 induced low levels of IL-10 from all PBMC donors. IL-6 was a notable exception, where in the soluble format at 500 nM, AMX-818 induced levels of IL-6 from all donors that exceeded those induced by the anti-CD3 antibody positive control by an average of 4.6-fold increase in the means. High levels of IL-6 were also induced by 2 of 5 donors in the wet plate-coated format, and lower levels of IL-6 were also seen at the highest concentration of AMX-818(PAT). However, importantly, such elevated IL-6 levels were not accompanied by increases in TNF-α, IFN-γ, and IL-2, which are cytokines commonly co-associated with IL-6 secretion under conditions of CRS, nor were they observed in cynomolgus monkeys dosed with AMX-818 at up to 50 mg/kg. In contrast, the activated AMX-818(PAT) induced high levels of IL-6 in cynos at doses ≤0.3 mg/kg that were accompanied by increases in the additional inflammatory cytokines.

In vivo pharmacology, PK, and toxicology studies were conducted to characterize the efficacy and safety of AMX-818 and its metabolites. In addition to standard toxicology endpoints, the proteolytic stability of AMX-818 in circulation was evaluated in cynomolgus monkeys administered high doses of AMX-818 or under conditions of induced inflammation and in vitro following extended incubation in plasma from patients with cancer or systemic autoimmune disease. Preferential cleavage of AMX-818 in tumors was evident resulting in protease-dependent efficacy, while its peripheral stability in NHP provided a large safety margin relative to AMX-818(PAT) that predicts an increased therapeutic index. Together, these data support strong conditional masking of AMX818 that enables localized tumor activity with concomitant stability and effective masking in circulation and peripheral tissues.

Several in vivo efficacy studies were conducted to evaluate the impact of AMX-818 in redirecting T cells to kill HER2-expressing tumors. Since AMX-818 is not cross-reactive to mouse HER2 or CD3, immunodeficient mice were inoculated with human HER2-expressing xenograft tumors and engrafted with human PBMC (hPBMC) as a source of effector T cells. Anti-tumor activity of AMX-818 was assessed in the HER2-high BT-474 breast model (~975,000 HER2 receptors) and HER2-low HT-55 colorectal model (25,000 receptors).

In the BT474 model, administration of equimolar doses of AMX-818 and its prototype AMX-818-P1 at 2.1 mg/kg or the unmasked AMX-818(PAT) at 0.9 mg/kg induced robust and complete tumor regressions. The anti-tumor efficacy of AMX-818 was dependent on protease cleavage of its masks, as demonstrated by the lack of significant tumor growth inhibition in mice treated with a form of AMX-818 lacking its protease release sites (AMX-818-NoClvSite). AMX-818-P1 and AMX-818(PAT) induced comparable activation of T cells in the tumor microenvironment as assessed by upregulation of activation markers CD25 and CD69 on CD4 and CD8+ T cells by flow cytometry. Importantly, T cells were not activated in the periphery even by the unmasked AMX-818(PAT) where human HER2 is not expressed, consistent with a requirement for dual engagement of both HER2 and CD3 to activate T cells and redirect their killing.

A single 2.1 mg/kg dose of AMX-818 was sufficient to induce tumor regressions in mice bearing large established BT-474 tumors (478 $mm^3$ mean tumor volume) within 4 days of dosing. The efficacy was dependent on both HER2 expression and T cells, as demonstrated by the lack of activity of a non-tumor binding variant NB-XPAT (a version of AMX-818, in which its HER2 binding domain was replaced with a non-HER2 binding scFv) or of AMX-818 when dosed in tumor-bearing mice lacking hPBMCs. These findings further support the requirement for dual engagement of AMX-818 for its activity and provide a safety measure should AMX-818 become cleaved in normal tissue where HER2 is absent.

In mice bearing HER2-low HT-55 tumors, AMX-818 also induced dose- and protease-dependent efficacy, with 5.1 mg/kg inducing complete tumor regression in all mice (103% TGI, p<0.01), and 2.1 mg/kg inducing 70% tumor growth inhibition. Efficacy by AMX-818 in a model expressing 25,000 HER2 receptors provides potential for treating patients with multiple cancer types that include tumors with low levels of HER2 expression. Finally, preferential unmasking of a fluorophore-labeled AMX-818 to an average of 25.2% AMX-818(PAT) was evident in tumors compared to <2% in heart, brain and liver tissue combined following a 2-day incubation in BT-474 tumor-bearing mice, supporting the key tenants of localized dysregulation of proteases in tumors and the dominance of protease inhibition in normal tissues.

Terminology

As used herein, the following terms have the meanings ascribed to them unless specified otherwise.

As used in the specification and claims, the singular forms "a," "an," and "the" include plural references unless the context clearly dictates otherwise. For example, the term "a cell" includes a plurality of cells, including mixtures thereof.

The terms "polypeptide," "peptide," and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified, for example, by disulfide bond formation, glycosylation, lipidation, acetylation, phosphorylation, or any other manipulation, such as conjugation with a labeling component.

As used herein the term "amino acid" refers to either natural and/or unnatural or synthetic amino acids, including but not limited to glycine and both the D or L optical isomers, and amino acid analogs and peptidomimetics. Standard single or three letter codes are used to designate amino acids.

A "host cell" includes an individual cell or cell culture which can be or has been a recipient for the subject vectors. Host cells include progeny of a single host cell. The progeny may not necessarily be completely identical (in morphology or in genomic of total DNA complement) to the original parent cell due to naturally occurring or genetically engineered variation A "chimeric" protein contains at least one fusion polypeptide comprising regions in a different position in the sequence than that which occurs in nature. The regions may normally exist in separate proteins and are brought together in the fusion polypeptide; or they may normally exist in the same protein but are placed in a new arrangement in the fusion polypeptide. A chimeric protein may be created, for example, by chemical synthesis, or by creating and translating a polynucleotide in which the peptide regions are encoded in the desired relationship.

"Conjugated", "linked," "fused," and "fusion" are used interchangeably herein. These terms refer to the joining together of two more chemical elements or components, by whatever means including chemical conjugation or recombinant means.

The terms "polynucleotides", "nucleic acids", "nucleotides" and "oligonucleotides" are used interchangeably. They refer to a polymeric form of nucleotides of any length, either deoxyribonucleotides or ribonucleotides, or analogs thereof. Polynucleotides may have any three-dimensional structure, and may perform any function, known or unknown. A polynucleotide may comprise modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component.

As used herein, polynucleotides having "homology" or that are "homologous" are those which hybridize under stringent conditions as defined herein and have at least 70%, preferably at least 80%, more preferably at least 90%, more preferably 95%, more preferably 97%, more preferably 98%, and even more preferably 99% sequence identity to those sequences.

The terms "percent identity" and "% identity," as applied to polynucleotide sequences, refer to the percentage of residue matches between at least two polynucleotide sequences aligned using a standardized algorithm. Such an algorithm may insert, in a standardized and reproducible way, gaps in the sequences being compared in order to optimize alignment between two sequences, and therefore achieve a more meaningful comparison of the two sequences. Percent identity may be measured over the length of an entire defined polynucleotide sequence, for example, as defined by a particular SEQ ID number, or may be measured over a shorter length, for example, over the length of a fragment taken from a larger, defined polynucleotide sequence, for instance, a fragment of at least 45, at least 60, at least 90, at least 120, at least 150, at least 210 or at least 450 contiguous residues. Such lengths are exemplary only, and it is understood that any fragment length supported by the sequences shown herein, in the tables, figures or Sequence Listing, may be used to describe a length over which percentage identity may be measured.

"Percent (%) amino acid sequence identity," with respect to the polypeptide sequences identified herein, is defined as the percentage of amino acid residues in a query sequence that are identical with the amino acid residues of a second, reference polypeptide sequence or a portion thereof, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. Percent identity may be measured over the length of an entire defined polypeptide sequence, for example, as defined by a particular SEQ ID number, or may be measured over a shorter length, for example, over the length of a fragment taken from a larger, defined polypeptide sequence, for instance, a fragment of at least 15, at least 20, at least 30, at least 40, at least 50, at least 70 or at least 150 contiguous residues. Such lengths are exemplary only, and it is understood that any fragment length supported by the sequences shown herein, in the tables, figures or Sequence Listing, may be used to describe a length over which percentage identity may be measured.

As used herein, "repetitiveness" of an XTEN sequence refers to the 3-mer repetitiveness and can be measured by computer programs or algorithms or by other means known in the art. The 3-mer repetitiveness of an XTEN is assessed by determining the number of occurrences of the overlapping 3-mer sequences within the polypeptide. For example, a polypeptide of 200 amino acid residues has 198 overlapping 3-amino acid sequences (3-mers), but the number of unique 3-mer sequences will depend on the amount of repetitiveness within the sequence. A score can be generated (hereinafter "subsequence score") that is reflective of the degree of repetitiveness of the 3-mers in the overall polypeptide sequence. In the context of the present invention, "subsequence score" means the sum of occurrences of each unique 3-mer frame across a 200 consecutive amino acid sequence of the polypeptide divided by the absolute number of unique 3-mer subsequences within the 200 amino acid sequence. Examples of such subsequence scores derived from the first 200 amino acids of repetitive and non-repetitive polypeptides are presented in Example 73 of International Patent Application Publication No. WO 2010/091122 A1, which is incorporated by reference in its entirety. In some embodiments, the present invention provides BPXTEN each comprising XTEN in which the XTEN can have a subsequence score less than 16, or less than 14, or less than 12, or more preferably less than 10."

The term "substantially non-repetitive XTEN," as used herein, refers to an XTEN, wherein (1) there are few or no instances of four contiguous amino acids in the XTEN sequence that are identical amino acid types and wherein (2) the XTEN has a subsequence score (defined in the preceding paragraph herein) of 12, or 10 or less or that there isn't a pattern in the order, from N- to C-terminus, of the sequence motifs that constitute the polypeptide sequence.

A "vector" is a nucleic acid molecule, preferably self-replicating in an appropriate host, which transfers an inserted nucleic acid molecule into and/or between host cells. The term includes vectors that function primarily for insertion of DNA or RNA into a cell, replication of vectors that function primarily for the replication of DNA or RNA, and expression vectors that function for transcription and/or translation of the DNA or RNA. Also included are vectors that provide more than one of the above functions. An "expression vector" is a polynucleotide which, when introduced into an appropriate host cell, can be transcribed and translated into a polypeptide(s). An "expression system" usually connotes a suitable host cell comprised of an expression vector that can function to yield a desired expression product.

The term "$t_{1/2}$" as used herein means the terminal half-life calculated as $\ln(2)/K_{el}$. $K_{el}$ is the terminal elimination rate constant calculated by linear regression of the terminal linear portion of the log concentration vs. time curve. Half-life typically refers to the time required for half the quantity of an administered substance deposited in a living organism to be metabolized or eliminated by normal biological processes. The terms "$t_{1/2}$", "terminal half-life", "elimination half-life" and "circulating half-life" are used interchangeably herein.

The terms "antigen," "target antigen," or "immunogen" are used interchangeably herein to refer to the structure or binding determinant that an antibody fragment or an antibody fragment-based therapeutic binds to or has specificity against.

The term "payload" as used herein refers to a protein or peptide sequence that has biological or therapeutic activity; the counterpart to the pharmacophore of small molecules. Examples of payloads include, but are not limited to, cytokines, enzymes, hormones and blood and growth factors. Payloads can further comprise genetically fused or chemically conjugated moieties such as chemotherapeutic agents, antiviral compounds, toxins, or contrast agents. These conjugated moieties can be joined to the rest of the polypeptide via a linker which may be cleavable or non-cleavable.

As used herein, "treatment" or "treating," "palliating," and "ameliorating" are used interchangeably herein. These terms refer to an approach for obtaining beneficial or desired results including but not limited to a therapeutic benefit and/or a prophylactic benefit. By "therapeutic benefit" is meant eradication or amelioration of the underlying disorder being treated. Also, a therapeutic benefit is achieved with the eradication or amelioration of one or more of the physiological symptoms associated with the underlying disease condition such that an improvement is observed in the subject, notwithstanding that the subject may still be afflicted with the underlying disorder. For prophylactic benefit, the compositions may be administered to a subject at risk of developing a particular disease condition, or to a subject reporting one or more of the physiological symptoms of a disease, even though a diagnosis of this disease may not have been made.

A "therapeutic effect," as used herein, refers to a physiologic effect, including but not limited to the cure, mitigation, amelioration, or prevention of disease condition in humans or other animals, or to otherwise enhance physical or mental wellbeing of humans or animals, caused by a fusion polypeptide of the invention other than the ability to induce the production of an antibody against an antigenic epitope possessed by the biologically active protein. Determination of a therapeutically effective amount is well within the capability of those skilled in the art, especially in light of the detailed disclosure provided herein.

The terms "therapeutically effective amount" and "therapeutically effective dose," as used herein, refers to an amount of a biologically active protein, either alone or as a part of a fusion protein composition, that is capable of having any detectable, beneficial effect on any symptom, aspect, measured parameter or characteristics of a disease state or condition when administered in one or repeated doses to a subject. Such effect need not be absolute to be beneficial. The disease condition can refer to a disorder or a disease.

The term "therapeutically effective dose regimen," as used herein, refers to a schedule for consecutively administered doses of a biologically active protein, either alone or as a part of a fusion protein composition, wherein the doses are given in therapeutically effective amounts to result in sustained beneficial effect on any symptom, aspect, measured parameter or characteristics of a disease state or condition.

Fusion Polypeptide

Disclosed herein includes a polypeptide (or fusion polypeptide) comprising one or more extended recombinant polypeptides (XTEN or XTENs) (as described more fully hereinbelow), a bispecific antibody construct (BsAb) linked to the XTEN(s), and one or more release segments (RS); the release segment is positioned between the XTEN and the bispecific antibody construct (BsAb); and the polypeptide (or fusion polypeptide) has an N-terminal amino acid and a C-terminal amino acid.

In some embodiments, the polypeptide comprises a first XTEN (such as those described below in the "EXTENDED RECOMBINANT POLYPEPTIDE (XTEN)" section or described anywhere else herein). In some embodiments, the polypeptide further comprises a second XTEN (such as those described below in the "EXTENDED RECOMBINANT POLYPEPTIDE (XTEN)" section or described anywhere else herein). In some embodiments, the polypeptide comprises an XTEN at or near its N-terminus (an "N-terminal XTEN"). In some embodiments, the polypeptide comprises an XTEN at or near its C-terminus (a "C-terminal XTEN"). In some embodiments, the polypeptide comprises both an N-terminal XTEN and a C-terminal XTEN. In some embodiments, the first XTEN is an N-terminal XTEN and the second XTEN is a C-terminal XTEN. In some embodiments, the first XTEN is a C-terminal XTEN and the second XTEN is an N-terminal XTEN.

As the bispecific antibody (BsAb), a biologically active polypeptide ("BP"), is linked to the one or more XTENs within the polypeptide, the polypeptide may be referred to as an XTEN-containing fusion polypeptide: "BPXTEN."

The XTEN can comprise one or more barcode fragments (as described more fully below) releasable (configured to be released) from the XTEN upon digestion of the fusion polypeptide (or BPXTEN) by a protease. In some embodiments, each barcode fragment differs in sequence and molecular weight from all other peptide fragments (including all other barcode fragments if present) that are releasable from the polypeptide upon complete digestion of the polypeptide by the protease.

The (fusion) polypeptide can comprise one or more reference fragments (as described more fully below) releasable (configured to be released) from the polypeptide, for example, upon the protease digestion which releases the barcode fragment(s) from the polypeptide. In some embodiments, each reference fragment can be a single reference fragment that differs in sequence and molecular weight from all other peptide fragments that are releasable from the polypeptide upon digestion of the polypeptide by the protease.

In some embodiments, the polypeptide has an N-terminal amino acid and a C-terminal amino acid. The polypeptide can comprise (a) an extended recombinant polypeptide (XTEN) comprising a barcode fragment (BAR) releasable from the polypeptide upon digestion by a protease; (b) a bispecific antibody construct (BsAb), comprising a first antigen binding fragment (AF1) that specifically binds to cluster of differentiation 3 T cell receptor (CD3), which AF1 comprises light chain complementarity-determining regions 1 (CDR-L1), 2 (CDR-L2), and 3 (CDR-L3) and heavy chain complementarity-determining regions 1 (CDR-H1), 2 (CDR-H2), and 3 (CDR-H3), wherein the CDR-H3 comprises an amino acid sequence of SEQ ID NO:10; and a second antigen binding fragment (AF2) that specifically binds to human epidermal growth factor receptor 2 (HER2); and (c) a release segment (RS) positioned between the XTEN and the bispecific antibody construct, wherein the XTEN is characterized in that: (i) it comprises at least 100, or at least 150 amino acids; (ii) at least 90% of its amino acid residues are identified herein by glycine (G), alanine (A), serine (S), threonine (T), glutamate (E) or proline (P); (iii) it comprises at least 4 different types of amino acids identified herein by G, A, S, T, E, or P; and (iv) the XTEN is formed from a plurality of non-overlapping sequence motifs that are each from 9 to 14 amino acids in length, wherein the plurality of non-overlapping sequence motifs comprise: (1) a set of non-overlapping sequence motifs, wherein each non-overlapping sequence motif of the set of non-overlapping sequence motifs is repeated at least two times in the XTEN; and (2) a non-overlapping sequence motif that occurs only once within the XTEN; wherein the barcode fragment (BAR) includes at least part of the non-overlapping sequence motif that occurs only once within the XTEN; wherein the barcode fragment (BAR) differs in sequence and molecular weight from all other peptides fragments that are releasable from the polypeptide upon complete digestion of the polypeptide by the protease; and wherein the barcode fragment (BAR) does not include the N-terminal amino acid or the C-terminal amino acid of the polypeptide. The polypeptide can be expressed as a fusion protein. The fusion protein, in an uncleaved state, can have a structural arrangement from N-terminus to C-terminus identified herein by AF1-AF2-RS-XTEN, AF2-AF1-RS-XTEN, XTEN-RS-AF1-AF2, or XTEN-RS-AF2-AF1.

In some embodiments of the polypeptides of this disclosure, the XTEN is a first extended recombinant polypeptide (XTEN1); the plurality of non-overlapping sequence motifs, from which the XTEN1 is formed, is a first plurality of non-overlapping sequence motifs; the BAR is a first barcode fragment (BAR1); and the RS is a first release segment (RS1). In some embodiments, the polypeptide can further comprise: (d) a second extended recombinant polypeptide (XTEN2), comprising: a second barcode fragment (BAR2) releasable from the polypeptide upon digestion by the protease; and (e) a second release segment (RS2) positioned between the second XTEN (XTEN2) and the bispecific antibody construct (BsAb), wherein the XTEN2 is characterized in that: (i) it comprises at least 100, or at least 150 amino acids; (ii) at least 90% of its amino acid residues are identified herein by glycine (G), alanine (A), serine (S), threonine (T), glutamate (E) or proline (P); and (iii) it comprises at least 4 different types of amino acids identified herein by G, A, S, T, E, or P; wherein the second barcode fragment (BAR2) differs in sequence and molecular weight from all other peptides fragments that are releasable from the polypeptide upon complete digestion of the polypeptide by the protease; and wherein the second barcode fragment (BAR2) does not include the N-terminal amino acid or the C-terminal amino acid of the polypeptide. The XTEN1 can be positioned N-terminal of the bispecific antibody construct (BsAb) and the XTEN2 can be positioned C-terminal of the bispecific antibody construct (BsAb). Alternatively, the XTEN1 can be positioned C-terminal of the bispecific antibody construct (BsAb) and the XTEN2 can be positioned N-terminal of the bispecific antibody construct (BsAb). In some embodiments of the polypeptide, where (iv) the XTEN2 can be formed from a second plurality of non-overlapping sequence motifs that are each from 9 to 14 amino acids in length, wherein the second plurality of non-overlapping sequence motifs comprise: (1) a second set of non-overlapping sequence motifs, wherein each non-overlapping sequence motif of the second set of non-overlapping sequence motifs is repeated at least two times in the second XTEN; and (2) a non-overlapping sequence motif that occurs only once within the second XTEN; and wherein the second barcode fragment (BAR2) includes at least part of the non-overlapping sequence motif that occurs only once within the second XTEN. The polypeptide can be expressed as a fusion protein, where the fusion protein, in an uncleaved state, can have a structural arrangement from N-terminus to C-terminus identified herein by XTEN1-RS1-AF1-AF2-RS2-XTEN2, XTEN1-RS1-AF2-AF1-RS2-XTEN2, XTEN2-RS2-AF1-AF2-RS1-XTEN1, XTEN2-RS2-AF2-AF1-RS1-XTEN1, XTEN1-RS1-diabody-RS2-XTEN2, or XTEN2-RS2-diabody-RS1-XTEN1. The diabody can comprise a light chain variable region (VL$_I$) of the AF1, a heavy chain variable region (VH$_I$) of the AF1, a light chain variable region (VL$_{II}$) of the AF2, and a heavy chain variable region (VH$_{II}$) of the AF2.

In some embodiments of the polypeptides of this disclosure, (a) the first extended recombinant polypeptide (XTEN1) can comprise an amino acid sequence having at least about 90%, 91%, 92%, 93%, 94%, 95%, 96%, 97%, 98%, 99%, or 100% sequence identity to a sequence set forth in Table 3a; (b) the bispecific antibody construct (BsAb) can comprise: (I) the first antigen binding fragment (AF1) comprising light chain complementarity-determining regions 1 (CDR-L1), 2 (CDR-L2), and 3 (CDR-L3) and heavy chain complementarity-determining regions 1 (CDR-H1), 2

(CDR-H2), and 3 (CDR-H3), wherein the CDR-H1, the CDR-H2, and the CDR-H3 comprise amino acid sequences of SEQ ID NOS: 8, 9, and 10, respectively; and (II) the second antigen binding fragment (AF2) comprising a light chain variable region (VL$_{II}$) identified herein by SEQ ID NOS: 778-783) and a heavy chain variable region (VH$_{II}$) identified herein by SEQ ID NOS: 878-883; (c) the first release segment (RS1) comprises an amino acid sequence having at least 90%, 91%, 92%, 93%, 94%, 95%, 96%, 97%, 98%, 99%, or 100% sequence identity to a sequence identified herein by SEQ ID NOS: 7001-7626; (d) the second extended recombinant polypeptide (XTEN2) comprises an amino acid sequence having at least about 90%, 91%, 92%, 93%, 94%, 95%, 96%, 97%, 98%, 99%, or 100% sequence identity to a sequence set forth in Table 3a; and (e) the second release segment (RS2) comprises an amino acid sequence having at least 90%, 91%, 92%, 93%, 94%, 95%, 96%, 97%, 98%, 99%, or 100% sequence identity to a sequence identified herein by SEQ ID NOS: 7001-7626, where the polypeptide can have a structural arrangement from N-terminus to C-terminus identified herein by: XTEN1-RS1-AF2-AF1-RS2-XTEN2, XTEN1-RS1-AF1-AF2-RS2-XTEN2, XTEN2-RS2-AF2-AF1-RS1-XTEN1, or XTEN2-RS2-AF1-AF2-RS1-XTEN1.

Extended Recombinant Polypeptide (XTEN)
Chain Length and Amino Acid Composition

In some embodiments, the XTEN comprises at least 100, or at least 150 amino acids. In some embodiments, the XTEN is from 100 to 3,000, or from 150 to 3,000 amino acids in length. In some embodiments, the XTEN is from 100 to 1,000, or from 150 to 1,000 amino acids in length. In some embodiments, the XTEN is at least (about) 100, at least (about) 150, at least (about) 200, at least (about) 250, at least (about) 300, at least (about) 350, at least (about) 400, at least (about) 450, at least (about) 500, at least (about) 550, at least (about) 600, at least (about) 650, at least (about) 700, at least (about) 750, at least (about) 800, at least (about) 850, at least (about) 900, at least (about) 950, at least (about) 1,000, at least (about) 1,100, at least (about) 1,200, at least (about) 1,300, at least (about) 1,400, at least (about) 1,500, at least (about) 1,600, at least (about) 1,700, at least (about) 1,800, at least (about) 1,900, or at least (about) 2,000 amino acids in length. In some embodiments, the XTEN is at most (about) 100, at most (about) 150, at most (about) 200, at most (about) 250, at most (about) 300, at most (about) 350, at most (about) 400, at most (about) 450, at most (about) 500, at most (about) 550, at most (about) 600, at most (about) 650, at most (about) 700, at most (about) 750, at most (about) 800, at most (about) 850, at most (about) 900, at most (about) 950, at most (about) 1,000, at most (about) 1,100, at most (about) 1,200, at most (about) 1,300, at most (about) 1,400, at most (about) 1,500, at most (about) 1,600, at most (about) 1,700, at most (about) 1,800, at most (about) 1,900, or at most (about) 2,000 amino acids in length. In some embodiments, the XTEN has (about) 100, (about) 150, (about) 200, (about) 250, (about) 300, (about) 350, (about) 400, (about) 450, (about) 500, (about) 550, (about) 600, (about) 650, (about) 700, (about) 750, (about) 800, (about) 850, (about) 900, (about) 950, (about) 1,000, (about) 1,100, (about) 1,200, (about) 1,300, (about) 1,400, (about) 1,500, (about) 1,600, (about) 1,700, (about) 1,800, (about) 1,900, or (about) 2,000 amino acids in length, or of a range between any two of the foregoing. In some embodiments, at least 90% of the amino acid residues of the XTEN are identified herein by glycine (G), alanine (A), serine (S), threonine (T), glutamate (E) or proline (P). In some embodiments, at least 91%, 92%, 93%, 94%, 95%, 96%, 97%, 98%, 99% or 100% of the amino acid residues of the XTEN are glycine (G), alanine (A), serine (S), threonine (T), glutamate (E) or proline (P). In some embodiments, the XTEN comprises at least 4 different types of amino acids are G, A, S, T, E, or P that is substantially randomized with respect to any other nonoverlapping sequence motif comprising the XTEN polypeptide. In some embodiments, the XTEN (e.g., XTEN1, XTEN2, etc.) is characterized in that: (i) it comprises at least 100, or at least 150 amino acids; (ii) at least 90% of the amino acid residues of the XTEN are glycine (G), alanine (A), serine (S), threonine (T), glutamate (E) or proline (P); and (iii) it comprises at least 4 different types of the amino acids from G, A, S, T, E, or P that is substantially randomized with respect to any other nonoverlapping sequence motif comprising the XTEN polypeptide. One of ordinary skill in the art will understand that, as used herein, the term "glutamate" is a synonym for "glutamic acid," and refers to the glutamic acid residue whether or not the side-chain carboxyl is deprotonated. In some embodiments, the XTEN-containing fusion polypeptide comprises a first XTEN and a second XTEN. In some embodiments, the sum of the total number of amino acids in the first XTEN and the total number of amino acids in the second XTEN is at least 300, at least 350, at least 400, at least 500, at least 600, at least 700, or at least 800 amino acids.

Non-Overlapping Sequence Motif

In some embodiments, the XTEN comprises, or is formed from, a plurality of non-overlapping sequence motifs. In some embodiments, at least one of the non-overlapping sequence motifs is recurring (or repeated at least two times in the XTEN), and wherein at least another one of the non-overlapping sequence motifs is non-recurring (or found only once within the XTEN). In some embodiments, the plurality of non-overlapping sequence motifs comprises (a) a set of (recurring) non-overlapping sequence motifs, wherein each non-overlapping sequence motif of the set of non-overlapping sequence motifs is repeated at least two times in the XTEN; and (b) a non-overlapping (non-recurring) sequence motif that occurs (or is found) only once within the XTEN. In some embodiments, each non-overlapping sequence motif is from 9 to 14 (or 10 to 14, or 11 to 13) amino acids in length. In some embodiments, each non-overlapping sequence motif is 12 amino acids in length. In some embodiments, the plurality of non-overlapping sequence motifs comprises a set of non-overlapping (recurring) sequence motifs, wherein each non-overlapping sequence motif of the set of non-overlapping sequence motifs is (1) repeated at least two times in the XTEN; and (2) is between 9 and 14 amino acids in length. In some embodiments, the set of (recurring) non-overlapping sequence motifs comprises 12-mer sequence motifs identified herein by SEQ ID NOs: 179-200 and 1715-1722 in Table 1. In some embodiments, the set of (recurring) non-overlapping sequence motifs comprises 12-mer sequence motifs identified herein by SEQ ID NOs: 186-189 in Table 1. In some embodiments, the set of (recurring) non-overlapping sequence motifs comprise at least two, at least three, or all four of 12-mer sequence motifs of SEQ ID NOs: 186-189 in Table 1.

TABLE 1

Exemplary 12-Mer Sequence Motifs for Construction of XTENs

| Motif Family* | Amino Acid Sequence | SEQ ID NO. |
|---|---|---|
| AD | GESPGGSSGSES | 182 |
| AD | GSEGSSGPGESS | 183 |
| AD | GSSESGSSEGGP | 184 |

TABLE 1-continued

Exemplary 12-Mer Sequence Motifs for Construction of XTENs

| Motif Family* | Amino Acid Sequence | SEQ ID NO. |
|---|---|---|
| AD | GSGGEPSESGSS | 185 |
| AE, AM | GSPAGSPTSTEE | 186 |
| AE, AM, AQ | GSEPATSGSETP | 187 |
| AE, AM, AQ | GTSESATPESGP | 188 |
| AE, AM, AQ | GTSTEPSEGSAP | 189 |
| AF, AM | GSTSESPSGTAP | 190 |
| AF, AM | GTSTPESGSASP | 191 |
| AF, AM | GTSPSGESSTAP | 192 |
| AF, AM | GSTSSTAESPGP | 193 |
| AG, AM | GTPGSGTASSSP | 194 |
| AG, AM | GSSTPSGATGSP | 195 |
| AG, AM | GSSPSASTGTGP | 196 |
| AG, AM | GASPGTSSTGSP | 197 |
| AQ | GEPAGSPTSTSE | 198 |
| AQ | GTGEPSSTPASE | 199 |
| AQ | GSGPSTESAPTE | 200 |
| AQ | GSETPSGPSETA | 179 |
| AQ | GPSETSTSEPGA | 180 |
| AQ | GSPSEPTEGTSA | 181 |
| BC | GSGASEPTSTEP | 1715 |
| BC | GSEPATSGTEPS | 1716 |
| BC | GTSEPSTSEPGA | 1717 |
| BC | GTSTEPSEPGSA | 1718 |
| BD | GSTAGSETSTEA | 1719 |
| BD | GSETATSGSETA | 1720 |
| BD | GTSESATSESGA | 1721 |
| BD | GTSTEASEGSAS | 1722 |

*Denotes individual motif sequences that, when used together in various permutations, results in a "family sequence"

Barcode Fragment

In some embodiments, the polypeptide comprises a barcode fragment (e.g., a first, second, or third barcode fragment of an XTEN) releasable from the polypeptide upon digestion by a protease. In some embodiments, the barcode fragment (1) is a portion of the XTEN that includes at least part of the (non-recurring, non-overlapping) sequence motif that occurs (or is found) only once within the XTEN; and (2) differs in sequence and molecular weight from all other peptide fragments that are releasable from the polypeptide upon complete digestion of the polypeptide by the protease. One of ordinary skill in the art will understand that the term "barcode fragment" (or "barcode," or "barcode sequence") can refer to either the portion of the XTEN cleavably fused within the polypeptide, or the resulting peptide fragment released from the polypeptide.

In some embodiments, the barcode fragment does not include the N-terminal amino acid or the C-terminal amino acid of the polypeptide. As described more fully below or described anywhere herein, in some embodiments, the barcode fragment is releasable (configured to be released) upon Glu-C digestion of the fusion polypeptide. In some embodiments, the barcode fragment does not include a glutamic acid that is immediately adjacent to another glutamic acid, if present, in the XTEN. In some embodiments, the barcode fragment has a glutamic acid at its C-terminus. One of ordinary skill in the art will understand that the C-terminus of a barcode fragment can refer to the "last" (or the most C-terminal) amino acid residue within the barcode fragment, when cleavably fused within an XTEN, even if other "non-barcode" amino acid residues are positioned C-terminal to the barcode fragment within the same XTEN. In some embodiments, the barcode fragment has an N-terminal amino acid that is immediately preceded by a glutamic acid residue. In some embodiments, the glutamic acid residue that precedes the N-terminal amino acid is not immediately adjacent to another glutamic acid residue. In some embodiments, the barcode fragment does not include a (second) glutamic acid residue at a position other than the C-terminus of the barcode fragment unless the glutamic acid is immediately followed by a proline. In some embodiments, the barcode fragment is positioned a distance from either the N-terminus of the polypeptide or the C-terminus of the polypeptide, wherein the distance is from 10 to 150, or 10 to 125 amino acids. In some embodiments, the barcode fragment is positioned within, or at a location of, 300, 280, 260, 250, 240, 220, 200, 190, 180, 170, 160, 150, 140, 130, 120, 110, 100, 90, 80, 70, 60, 50, 48, 40, 36, 30, 24, 20, 12, or 10 amino acids from the N-terminus of the polypeptide, or at a location in a range between any of the foregoing. In some embodiments, the barcode fragment is positioned within 200, within 150, within 100, or within 50 amino acids of the N-terminus of the polypeptide. In some embodiments, the barcode fragment is positioned at a location that is between 10 and 200, between 30 and 200, between 40 and 150, or between 50 and 100 amino acids from the N-terminus of the polypeptide. In some embodiments, the barcode fragment is positioned within, or at a location of, 300, 280, 260, 250, 240, 220, 200, 190, 180, 170, 160, 150, 140, 130, 120, 110, 100, 90, 80, 70, 60, 50, 48, 40, 36, 30, 24, 20, 12, or 10 amino acids from the C-terminus of the polypeptide, or at a location in a range between any of the foregoing. In some embodiments, the barcode fragment is positioned within 200, within 150, within 100, or within 50 amino acids of the C-terminus of the polypeptide. In some embodiments, the barcode fragment is positioned at a location that is between 10 and 200, between 30 and 200, between 40 and 150, or between 50 and 100 amino acids from the C-terminus of the polypeptide. In some embodiments, the barcode fragment (BAR) is characterized in that: (i) it does not include a glutamic acid that is immediately adjacent to another glutamic acid, if present, in the XTEN; (ii) it has a glutamic acid at its C-terminus; (iii) it has an N-terminal amino acid that is immediately preceded by a glutamic acid residue; and (iv) it is positioned a distance from either the N-terminus of the polypeptide or the C-terminus of the polypeptide, wherein the distance is from 10 to 150 amino acids, or from 10 to 125 amino acids in length. In some embodiments, the barcode fragment (i) does not include the N-terminal amino acid or the C-terminal amino acid of the polypeptide; (ii) does not include a glutamic acid that is immediately adjacent to another glutamic acid in the XTEN; (iii) has a glutamic acid at its C-terminus; (iv) has an N-terminal amino acid that is immediately preceded by a glutamic acid residue; and (v) is positioned a distance from either the N-terminus of the polypeptide or the C-terminus of the polypeptide, wherein the distance is from 10 to 150, or 10 to 125 amino acids in length. In some embodiments, the glutamic acid residue that precedes the N-terminal amino acid is not immediately adjacent to another glutamic acid residue. In some embodiments, the barcode fragment does not include a glutamic acid residue at a position other than the C-terminus of the barcode fragment unless the glutamic acid is immediately followed by a proline. One or ordinary skill in the art will understand the term "distance," as used herein, can refer to the number of amino acid residues from the N-terminus of the polypeptide to the most N-terminal amino acid residue of the barcode fragment, or from the C-terminus of the polypeptide to the most C-terminal amino acid residue of the barcode fragment. In some embodiments, for a barcoded XTEN fused to a biologically-active polypeptide, at least one barcode fragment (or at least two barcode fragments, or three barcode fragments) contained in the barcoded XTEN is positioned at least 50, 75, 100, 125, 150, 175, 200, 225, 250, 275, 300 amino acids from the biologically active polypeptide. In some embodiments, the barcode fragment is at least 4, at least 5, at least 6, at least 7, or at least 8 amino acids in length. In some embodiments, the barcode fragment is at least 4 amino acids in length. In some embodiments, the barcode fragment is 4, 5, 6, 7, 8, 9, 10, 11, 12, 13, 14, 15, 16, 17, 18, 19, 20, 21, 22, 23, 24, 25 amino acids in length, or in a range between any of the foregoing values. In some embodiments, the barcode fragment is between 4 and 20, between 5 and 15, between 6 and 12, or between 7 and 10 amino acids in length. In some embodiments, the barcode fragment comprises an amino acid sequence identified herein by SEQ ID NOs: 68-77 in Table 2.

TABLE 2

Exemplary Barcode Fragments Releasable Upon Glu-C Digest

| Amino Acid Sequence | SEQ ID NO: |
|---|---|
| SPATSGSTPE | 68 (BAR001) |
| GSAPATSE | 69 (BAR002) |
| GSAPGTATE | 70 (BAR003) |
| GSAPGTE | 71 (BAR004) |
| PATSGPTE | 72 (BAR005) |
| SASPE | 73 (BAR006) |
| PATSGSTE | 74 (BAR007) |
| GSAPGTSAE | 75 (BAR008) |
| SATSGSE | 76 (BAR009) |
| SGPGSTPAE | 77 (BAR010) |

In some embodiments of the polypeptides of this disclosure, the XTEN can have a length defined by a proximal end and a distal end, where (1) the proximal end is positioned, relative to the distal end, closer to the bispecific antibody construct (BsAb), and where (2) the barcode fragment (BAR) can be positioned within a region of the XTEN that extends, as measured from the distal end, between 5% and 50%, between 7% and 40%, or between 10% and 30% of the length of the XTEN.

In some embodiments of the polypeptides of this disclosure, the XTEN further comprises additional one or more barcode fragments, wherein said additional one or more barcode fragments each differ in sequence and molecular weight from all other peptides fragments that are releasable from said polypeptide upon complete digestion of said polypeptide by said protease. In some embodiments, a barcoded XTEN comprises only one barcode fragment. In some embodiments, a barcoded XTEN comprises a set of barcode fragments, comprising a first barcode fragment, such as those described above or anywhere else herein. In some embodiments, the set of barcode fragments comprises a second barcode fragment (or a further barcode fragment), such as those described above or anywhere else herein. In some embodiments, the set of barcode fragments comprises a third barcode fragment, such as those described above or anywhere else herein. The set of barcode fragments fused within an N-terminal XTEN can be referred to as an N-terminal set of barcodes ("an N-terminal set"). The set of barcode fragments fused within a C-terminal XTEN can be referred to as a C-terminal set of barcodes ("a C-terminal set"). In some embodiments, the N-terminal set comprises a first barcode fragment and a second barcode fragment. In some embodiments, the N-terminal set further comprises a third barcode fragment. In some embodiments, the C-terminal set comprises a first barcode fragment and a second barcode fragment. In some embodiments, the C-terminal set further comprises a third barcode fragment. In some embodiments, the second barcode fragment is positioned N-terminal to the first barcode fragment of the same set. In some embodiments, the second barcode fragment is positioned C-terminal to the first barcode fragment of the same set. In some embodiments, the third barcode fragment is positioned N-terminal to both the first and second barcode fragments. In some embodiments, the third barcode fragment is positioned C-terminal to both the first and second barcode fragments. In some embodiments, the third barcode fragment is positioned between the first and second barcode fragments. In some embodiments, the polypeptide comprises a set of barcode fragments that includes a first barcode fragment, a further (second) barcode fragment, and at least one additional barcode fragment, wherein each barcode fragment of the set of barcode fragments (1) is a portion of the second XTEN and (2) differs in sequence and molecular weight from all other peptides fragments that are releasable from the polypeptide upon complete digestion of the polypeptide by the protease.

Exemplary Barcoded XTEN

Amino acid sequences of 13 exemplary barcoded XTENs, containing one barcode (e.g., SEQ ID NOs: 8002-8003, 8005-8009, and 8013), or two barcodes (e.g., SEQ ID NOS: 8001, 8004, and 8012), or three barcodes (e.g., SEQ ID NO: 8011), are illustrated in Table 3a. Among these 13 exemplary barcoded XTEN, six (SEQ ID NOs: 8001-8003, 8008-8009, and 8011) are to be fused to a biologically-active protein at the C-terminal of the biologically-active protein, and seven (SEQ ID NOS: 8004-8007, 8010, and 8012-8013) are to be fused at the N-terminal of the biologically-active protein. In some embodiments, the XTEN has at least 90%, at least 92%, at least 95%, at least 98%, at least 99% or 100% sequence identity to a sequence identified herein by SEQ ID NOs: 8001-8020 in Table 3a.

TABLE 3a

Exemplary Barcoded XTENs

| SEQ ID NO. | XTEN Type | # of Barcode(s) | Amino Acid Sequence | Total # of AAs |
|---|---|---|---|---|
| 8001 | C-terminal XTEN | 2 | PGSPAGSPTSTEEGTSESATPESGPGTSTEPSEGSAPGSPAGS PTSTEEGTSTEPSEGSAPGTSTEPSEGSAPGTSESATPESGPG SEPATSGSETPGSEPATSGSETPGSPAGSPTSTEEGTSESATP ESGPGTSTEPSEGSAPGTSTEPSEGSAPGSPAGSPTSTEEGTS TEPSEGSAPGTSTEPSEGSAPGTSESATPESGPGTSTEPSEGS APGTSESATPESGPGSEPATSGSETPGTSTEPSEGSAPGTSTE PSEGSAPGTSESATPESGPGTSESATPESGPGSPAGSPTSTEE GTSESATPESGPGSEPATSGSETPGTSESATPESGPGTSTEPS EGSAPGTSTEPSEGSAPGTSTEPSEGSAPGTSTEPSEGSAPGT STEPSEGSAPGTSTEPSEGSAPGSPAGSPTSTEEGTSTEPSEG SAPGTSESATPESGPGSEPATSGSETPGTSESATPESGPGSEP ATSGSETPGTSESATPESGPGTSTEPSEGSAPGTSESATPESG PGSPAGSPTSTEEGSPAGSPTSTEEGSPAGSPTSTEEGTSESA TPESGPGTSTEPSEGSAPGTSESATPESGPGSEPATSGSETPG TSESATPESGPGSEPATSGSETPGTSESATPESGPGTSTEPSE GSAPGSPAGSPTSTEEGTSESATPESGPGSEPATSGSETPGTS ESATPESGPGSPAGSPTSTEEGSPAGSPTSTEEGTSTEPSEGS APGTSESATPESGPGTSESATPESGPGftabTSESATPESGPGS EPATSGPTESGSEPATSGSETPGSPAGSPTSTEEGTSTEPSE GSAPGTESTPSEGSAPGSEPATSGSETPGTSESATPESGPGT STEPSEGSAPGEPEA | 864 |
| 8002 | C-terminal XTEN | 1 | PGSPAGSPTSTEEGTSESATPESGPGTSTEPSEGSAPGSPAGS PTSTEEGTSTEPSEGSAPGTSTEPSEGSAPGTSESATPESGPG SEPATSGSETPGSEPATSGSETPGSPAGSPTSTEEGTSESATP ESGPGTSTEPSEGSAPGTSTEPSEGSAPGSPAGSPTSTEEGTS TEPSEGSAPGTSTEPSEGSAPGTSESATPESGPGTSTEPSEGS APGTSESATPESGPGSEPATSGSETPGTSTEPSEGSAPGTSTE PSEGSAPGTSESATPESGPGTSESATPESGPGSPAGSPTSTEE GTSESATPESGPGSEPATSGSETPGTSESATPESGPGTSTEPS EGSAPGTSTEPSEGSAPGTSTEPSEGSAPGTSTEPSEGSAPGT STEPSEGSAPGTSTEPSEGSAPGSPAGSPTSTEEGTSTEPSEG SAPGTSESATPESGPGSEPATSGSETPGTSESATPESGPGSEP ATSGSETPGTSESATPESGPGTSTEPSEGSAPGTSESATPESG PGSPAGSPTSTEEGSPAGSPTSTEEGSPAGSPTSTEEGTSESA TPESGPGTSTEPSEGSAPGTSESATPESGPGSEPATSGSETPG TSESATPESGPGSEPATSGSETPGTSESATPESGPGTSTEPSE GSAPGSPAGSPTSTEEGTSESATPESGPGSEPATSGSETPGTS ESATPESGPGSPAGSPTSTEEGSPAGSPTSTEEGTSTEPSEGS APGTSESATPESGPGTSESATPESGPGTSESATPESGPGSEPA TSGPTESGSEPATSGSETPGSPAGSPTSTEEGTSTEPSEGSAP GTSTEPSEGSAPGSEPATSGSETPGTSESATPESGPGTSTEPS EGSAPGEPEA | 864 |
| 8003 | C-terminal XTEN | 1 | PGSPAGSPTSTEEGTSESATPESGPGTSTEPSEGSAPGSPAGS PTSTEEGTSTEPSEGSAPGTSTEPSEGSAPGTSESATPESGPG SEPATSGSETPGSEPATSGSETPGSPAGSPTSTEEGTSESATP ESGPGTSTEPSEGSAPGTSTEPSEGSAPGSPAGSPTSTEEGTS TEPSEGSAPGTSTEPSEGSAPGTSESATPESGPGTSTEPSEGS APGTSESATPESGPGSEPATSGSETPGTSTEPSEGSAPGTSTE PSEGSAPGTSESATPESGPGTSESATPESGPGSPAGSPTSTEE GTSESATPESGPGSEPATSGSETPGTSESATPESGPGTSTEPS EGSAPGTSTEPSEGSAPGTSTEPSEGSAPGTSTEPSEGSAPGT STEPSEGSAPGTSTEPSEGSAPGSPAGSPTSTEEGTSTEPSEG SAPGTSESATPESGPGSEPATSGSETPGTSESATPESGPGSEP ATSGSETPGTSESATPESGPGTSTEPSEGSAPGTSESATPESG PGSPAGSPTSTEEGSPAGSPTSTEEGSPAGSPTSTEEGTSESA TPESGPGTSTEPSEGSAPGTSESATPESGPGSEPATSGSETPG TSESATPESGPGSEPATSGSETPGTSESATPESGPGTSTEPSE GSAPGSPAGSPTSTEEGTSESATPESGPGSEPATSGSETPGTS ESATPESGPGSPAGSPTSTEEGSPAGSPTSTEEGTSTEPSEGS APGTSESATPESGPGTSESATPESGPGTSESATPESGPGSEPA TSGSETPGSEPATSGSETPGSPAGSPTSTEEGTSTEPSEGSAP GTESTPSEGSAPGSEPATSGSETPGTSESATPESGPGTSTEPS EGSAPGEPEA | 864 |
| 8004 | N-terminal XTEN | 2 | ASSPAGSPTSTESGTSESATPESGPGTETEPSEGSAPGTSESA TPESGPGTSESATPGSETPGTSESATPESGPGSTPAESGSETP GTSESATPESGPGTSTEPSEGSAPGSPAGSPTSTEEGTSESAT PESGPGSESPATSGSTPEGTSESATPESGPGSPAGSPTSTEEGS PAGSPTSTEEGTSTEPSEGSAPGTSESATPESGPGTSESATPE SGPGTSESATPESGPGSEPATSGSETPGSEPATSGSETPGSPA GSPTSTEEGTSTEPSEGSAPGTSTEPSEGSAPGGSAP | 288 |

TABLE 3a-continued

Exemplary Barcoded XTENs

| SEQ ID NO. | XTEN Type | # of Barcode(s) | Amino Acid Sequence | Total # of AAs |
|---|---|---|---|---|
| 8005 | N-terminal XTEN | 1 | ASSPAGSPTSTESGTSESATPESGPGTSTEPSEGSAPGTSESA TPESGPGSEPATSGSETPGTSESATPESGPGSEPATSGSETPG TSESATPESGPGTSTEPSEGSAPGSPAGSPTSTEEGTSESATP ESGPGESPATSGSTPEGTSESATPESGPGSPAGSPTSTEEGSP AGSPTSTEEGTSTEPSEGSAPGTSESATPESGPGTSESATPES GPGTSESATPESGPGSEPATSGSETPGSEPATSGSETPGSPAG SPTSTEEGTSTEPSEGSAPGTSTEPSEGSAPGGSAP | 288 |
| 8006 | N-terminal XTEN | 1 | ASSPAGSPTSTESGTSESATPESGPGTSTEPSEGSAPGTSESA TPESGPGSEPATSGSETPGTSESATPESGPGSTPAESGSETP GTSESATPESGPGTSTEPSEGSAPGSPAGSPTSTEEGTSESAT PESGPGEEPATSGSTPEGTSESATPESGPGSPAGSPTSTEEGS PAGSPTSTEEGTSTEPSEGSAPGTSESATPESGPGTSESATPE SGPGTSESATPESGPGSEPATSGSETPGSEPATSGSETPGSPA GSPTSTEEGTSTEPSEGSAPGTSTEPSEGSAPGGSAP | 288 |
| 8007 | N-terminal XTEN | 1 | ASSPAGSPTSTESGTSESATPESGPGTSTEPSEGSAPGTSESA TPESGPGSEPATSGSETPGTSESATPESGPGSTPAESGSETP GTSESATPESGPGTSTEPSEGSAPGSPAGSPTSTEEGTSESAT PESGPGSEPATSGSETPGTSESATPESGPGSPAGSPTSTEEGS PAGSPTSTEEGTSTEPSEGSAPGTSESATPESGPGTSESATPE SGPGTSESATPESGPGSEPATSGSETPGSEPATSGSETPGSPA GSPTSTEEGTSTEPSEGSAPGTSTEPSEGSAPGGSAP | 288 |
| 8008 | C-terminal XTEN | 1 | PGSPAGSPTSTEEGTSESATPESGPGTSTEPSEGSAPGSPAGS PTSTEEGTSTEPSEGSAPGTSTEPSEGSAPGTSESATPESGPG SEPATSGSETPGSEPATSGSETPGSPAGSPTSTEEGTSESATP ESGPGTSTEPSEGSAPGTSTEPSEGSAPGSPAGSPTSTEEGTS TEPSEGSAPGTSTEPSEGSAPGTSESATPESGPGTSTEPSEGS APGTSESATPESGPGSEPATSGSETPGTSTEPSEGSAPGTSTE PSEGSAPGTSESATPESGPGTSESATPESGPGSPAGSPTSTEE GTSESATPESGPGSEPATSGSETPGTSESATPESGPGTSTEPS EGSAPGTSTEPSEGSAPGTSTEPSEGSAPGTSTEPSEGSAPGT STEPSEGSAPGTSTEPSEGSAPGSPAGSPTSTEEGTSTEPSEG SAPGTSESATPESGPGSEPATSGSETPGTSESATPESGPGSEP ATSGSETPGTSESATPESGPGTSTEPSEGSAPGTSESATPESG PGSPAGSPTSTEEGSPAGSPTSTEEGSPAGSPTSTEEGTSESA TPESGPGTSTEPSEGSAPGTSESATPESGPGSEPATSGSETPG TSESATPESGPGSEPATSGSETPGTSESATPESGPGTSTEPSE GSAPGSPAGSPTSTEEGTSESATPESGPGSEPATSGSETPGTS ESATPESGPGSPAGSPTSTEEGSPAGSPTSTEEGTSTEPSEGS APGTSESATPESGPGTSESATPESGPGTSESATPESGPGSEPA TSGSETPGSEPATSGSETPGSPAGSPTSTEEGTSTEPSE<u>GSAP GTE</u>STPSEGSAPGSEPATSGSETPGTSESATPESGPGTSTEPS EGSAPG | 864 |
| 8009 | C-terminal XTEN | 1 | PGSPAGSPTSTEEGTSESATPESGPGSEPATSGSETPGTSESA TPESGPGTSTEPSEGSAPGTSTEPSEGSAPGTSTEPSEGSAPG TSTEPSEGSAPGTSTEPSEGSAPGTSTEPSEGSAPGSPAGSPT STEEGTSTEPSEGSAPGTSESATPESGPGSEPATSGSETPGTS ESATPESGPGSEPATSGSETPGTSESATPESGPGTSTEPSEGS APGTSESATPESGPGSPAGSPTSTEEGSPAGSPTSTEEGSPAG SPTSTEEGTSESATPESGPGTSTEPSEGSAPGTSESATPESGP GSEPATSGSETPGTSESATPESGPGSEPATSGSETPGTSESAT PESGPGTSTEPSEGSAPGSPAGSPTSTEEGTSESATPESGPGS EPATSGSETPGTSESATPESGPGSPAGSPTSTEEGSPAGSPTS TEEGTSTEPSEGSAPGTSESATPESGPGTSESATPESGPGTSE SATPESGPGSEPATSGSETPGSEPATSGSETPGSPAGSPTSTE EGTSTEPSE<u>GSAPGTE</u>STPSEGSAPGSEPATSGSETPGTSES ATPESGPGTSTEPSEGSAPG | 576 |
| 8010 | N-terminal XTEN | 2 | SAGSPGSPAGSPTSTEEGTSESATPESGPGTSTEPSEGSAPGS PAGSPTSTEEGTSTEPSEGSAPGTSTEPSEGSAPGTSESATPE <u>SGPGSTPAE</u>SGSETPGSEPATSGSETPGSPAGSPTSTEEGTS ESATPESGPGTSTEPSEGSAPGTSTEPSEGSAPGSPAGSPTST EEGTSTEPSEGSAPGTSTEPSEGSAPGTSESATPESGPGTSTE PSEGSAPGTSESATPESGPGSEPATSGSTETPGTSTEPSEGSA PGTSTEPSEGSAPGTSESATPESGPGTSESATPESGPGSPAGS PTSTEEGTSESATPESGPGSEPATSGSETPGTSESATPESGPG TSTEPSEGSAPGTSTEPSEGSAPGTSESATPESGPGTSTEPSE GSAPGTSTEPSEGSAPGSPAGSPTSTEEGTS TEPSEGSAPGTSESATPESGPGSEPATSGSETPGTSESATPES GPGSEPATSGSETPGTSESATPESGPGTSTEPSEGSAPGTSES ATPESGPGSPAGSPTSTEEGSPAGSPTSTEEGSPAGSPTSTEE GTSESATPESGPGTSTEPSEGSAPGTSESATPESGPGSEPATS | 1152 |

TABLE 3a-continued

Exemplary Barcoded XTENs

| SEQ ID NO. | XTEN Type | # of Barcode(s) | Amino Acid Sequence | Total # of AAs |
|---|---|---|---|---|
| | | | GSETPGTSESATPESGPGSEPATSGSETPGTSESATPESGPGT STEPSEGSAPGSPAGSPTSTEEGTSESATPESGPGSEPATSGS ETPGTSESATPESGPGSPAGSPTSTEEGSPAGSPTSTEEGTST EPSEGSAPGTSESATPESGPGTSESATPESGPGTSESATPESG PGSEPATSGSETPGSEPATSGSETPGSPAGSPTSTEEGTSTEP SEGSAPGTSTEPSEGSAPGSEPATSGSETPGTSESATPESGPG TSTEPSEGSAPGSPAGSPTSTEEGTSESATPESGPGTSTEPSE GSAPGSPAGSPTSTEEGTSTEPSEGSAPGTSTEPSEGSAPGTS ESATPESGPGSEPATSGSETPGSEPATSGSETPGSPAGSPTST EEGTSESATPESGPGTSTEPSEGSAPGTSTEPSEGSAPGSPAG SPTSTEEGTSTEPSEGSAPGTSTEPSEGSAPGTSESATPESGP GTSTEPSEGSAPGTSESATPESGPGSEPATSGSETPGTSTEPS EGSAPGTSTEPSEGSAPGTSESATPESGPGTESAS | |
| 8011 | C-terminal XTEN | 3 | SAGSPGSPAGSPTSTEEGTSESATPESGPGTSTEPSEGSAPGS PAGSPTSTEEGTSTEPSEGSAPGTSTEPSEGSAPGTSESATPE SGPGSEPATSGSETPGSEPATSGSETPGSPAGSPTSTEEGTSE SATPESGPGTSTEPSEGSAPGTSTEPSEGSAPGSPAGSPTSTE EGTSTEPSEGSAPGTSTEPSEGSAPGTSESATPESGPGTSTEP SEGSAPGTSESATPESGPGSEPATSGSETPGTSTEPSEGSAPG TSTEPSEGSAPGTSESATPESGPGTSESATPESGPGSPAGSPT STEEGTSESATPESGPGSEPATSGSETPGTSESATPESGPGTS TEPSEGSAPGTSTEPSEGSAPGTSTEPSEGSAPGTSTEPSEGS APGTSTEPSEGSAPGTSTEPSEGSAPGSPAGSPTSTEEGTSTE PSEGSAPGTSESATPESGPGSEPATSGSETPGTSESATPESGP GSEPATSGSETPGTSESATPESGPGTSTEPSEGSAPGTSESAT PESGPGSPAGSPTSTEEGSPAGSPTSTEEGSPAGSPTSTEEGT SESATPESGPGTSTEPSEGSAPGTSESATPESGPGSEPATSGS ETPGTSESATPESGPGSEPATSGSETPGTSESATPESGPGTST EPSEGSAPGSPAGSPTSTEEGTSESATPESGPGSEPATSGSET PGTSESATPESGPGSPAGSPTSTEEGSPAGSPTSTEEGTSTEP SEGSAPGTSESATPESGPGTSESATPESGPGTSESATPESGPG SEPATSGSETPGSEPATSGSETPGSPAGSPTSTEEGTSTEPSE GSAPGTSTEPSEGSAPGSEPATSGSETPGTSESATPESGPGTS TEPSEGSAPGSPAGSPTSTEEGTSESATPESGPGTSTEPSEGS APGSPAGSPTSTEEGTSTEPSEGSAPGTSTEPSEGSAPGTSES ATPESGPGSEPATSGSETPGSEPATSGSTETPGSPAGSPTSTE EGTSESATPESGPGTSTEPSEGSAPGTSTEPSEGSAPGSPAGS PTSTEEGTSTEPSEGSAPGTATESPEGSAPGTSESATPESGP GTSTEPSEGSAPGTSAESATPESGPGSEPATSGSETPGTSTE PSEGSAPGTSTEPSEGSAPGTSESATPESGPGTESAS | 1152 |
| 8012 | N-terminal XTEN | 2 | GSPAGSPTSTEEGTSESATPESGPGTSTEPSEGSAPGSPAGSP TSTEEGTSTEPSEGSAPGTSTEPSEGSAPATSESATPESGPGS EPATSGSETPGSEPATSGSETPGSPAGSPTSTEEGTSESASPE SGPGTSTEPSEGSAPGTSTEPSEGSAPGSPAGSPTSTEEGTST EPSEGSAPGTSTEPSEGSAPGTSESATPESGPGTSTEPSEGSA PGTSESATPESGPGSEPATSGSETPGTSTEPSEGSAPGTSTEP SEGSAPGTSESATPESGPGTSESATPESGPGSPAGSPTSTEEG TSESATPESGPGSEPATSGSETPGTSESATPESGPGTSTEPSE GSAPGTSTEPSEGSAPGTSTEPSEGSAPGTSTEPSEGSAPGTS TEPSEGSAPGTSTEPSEGSAPGSPAGSPTSTEEGTSTEPSEGS APGTSESATPESGPGSEPATSGSETPGTSESATPESGPGSEPA TSGSETPGTSESATPESGPGTSTEPSEGSAPGTSESATPESGP GSPAGSPTSTEEGSPAGSPTSTEEGSPAGSPTSTEEGTSESAT PESGPGTSTEPSEGSAPGTSESATPESGPGSEPATSGSETPGT SESATPESGPGSEPATSGSETPGTSESATPESGPGTSTEPSEG SAPGSPAGSPTSTEEGTSESATPESGPGSEPATSGSETPGTSE SATPESGPGSPAGSPTSTEEGSPAGSPTSTEEGTSTEPSEGSA PGTSESATPESGPGTSESATPESGPGTSESATPESGPGSEPAT SGSETPGSEPATSGSETPGSPAGSPTSTEEGTSTEPSEGSAPG TSTEPSEGSAPGSEPATSGSETPGTSESATPESGPGTSTEPSE GSAP | 864 |
| 8013 | N-terminal XTEN | 1 | GSPAGSPTSTEEGTSESATPESGPGTSTEPSEGSAPGSPAGSP TSTEEGTSTEPSEGSAPGTSTEPSEGSAPGTSESATPESGPGS ESATSGSETPGSEPATSGSETPGSPAGSPTSTEEGTSESATPE SGPGTSTEPSEGSAPGTSTEPSEGSAPGSPAGSPTSTEEGTST EPSEGSAPGTSTEPSEGSAPGTSESATPESGPGTSTEPSEGSA PGTSESATPESGPGSEPATSGSETPGTSTEPSEGSAPGTSTEP SEGSAPGTSESATPESGPGTSESATPESGPGSPAGSPTSTEEG TSESATPESGPGSEPATSGSETPGTSESATPESGPGTSTEPSE GSAPGTSTEPSEGSAPGTSTEPSEGSAPGTSTEPSEGSAPGTS TEPSEGSAPGTSTEPSEGSAPGSPAGSPTSTEEGTSTEPSEGS APGTSESATPESGPGSEPATSGSETPGTSESATPESGPGSEPA | 864 |

TABLE 3a-continued

Exemplary Barcoded XTENs

| SEQ ID NO. | XTEN Type | # of Barcode(s) | Amino Acid Sequence | Total # of AAs |
|---|---|---|---|---|
| | | | TSGSETPGTSESATPESGPGTSTEPSEGSAPGTSESATPESGP GSPAGSPTSTEEGSPAGSPTSTEEGSPAGSPTSTEEGTSESAT PESGPGTSTEPSEGSAPGTSESATPESGPGSEPATSGSETPGT SESATPESGPGSEPATSGSETPGTSESATPESGPGTSTEPSEG SAPGSPAGSPTSTEEGTSESATPESGPGSEPATSGSETPGTSE SATPESGPGSPAGSPTSTEEGSPAGSPTSTEEGTSTEPSEGSA PGTSESATPESGPGTSESATPESGPGTSESATPESGPGSEPAT SGSETPGSEPATSGSETPGSPAGSPTSTEEGTSTEPSEGSAPG TSTEPSEGSAPGSEPATSGSETPGTSESATPESGPGTSTEPSE GSAP | |
| 8014 | N-terminal XTEN | 1 | SPAGSPTSTESGTSESATPESGPGTSTEPSEGSAPGTSESATP ESGPGSEPATSGSETPGTSESATPESGPGSTPAESGSETPGT SESATPESGPGTSTEPSEGSAPGSPAGSPTSTEEGTSESATPE SGPGSEPATSGSETPGTSESATPESGPGSPAGSPTSTEEGSPA GSPTSTEEGTSTEPSEGSAPGTSESATPESGPGTSESATPESG PGTSESATPESGPGSEPATSGSETPGSEPATSGSETPGSPAGS PTSTEEGTSTEPSEGSAPGTSTEPSEGSAPGGSAP | 292 |
| 8015 | C-terminal XTEN | 1 | PGSPAGSPTSTEEGTSESATPESGPGSEPATSGSETPGTSESA TPESGPGTSTEPSEGSAPGTSTEPSEGSAPGTSTEPSEGSAPG TSTEPSEGSAPGTSTEPSEGSAPGTSTEPSEGSAPGSPAGSPT STEEGTSTEPSEGSAPGTSESATPESGPGSEPATSGSETPGTS ESATPESGPGSEPATSGSETPGTSESATPESGPGTSTEPSEGS APGTSESATPESGPGSPAGSPTSTEEGSPAGSPTSTEEGSPAG SPTSTEEGTSESATPESGPGTSTEPSEGSAPGTSESATPESGP GSEPATSGSETPGTSESATPESGPGSEPATSGSETPGTSESAT PESGPGTSTEPSEGSAPGSPAGSPTSTEEGTSESATPESGPGS EPATSGSETPGTSESATPESGPGSPAGSPTSTEEGSPAGSPTS TEEGTSTEPSEGSAPGTSESATPESGPGTSESATPESGPGTSE SATPESGPGSEPATSGSETPGSEPATSGSETPGSPAGSPTSTE EGTSTEPSEGSAPGTESTPSEGSAPGSEPATSGSETPGTSES ATPESGPGTSTEPSEGSAPGEPEA | 582 |
| 8016 | C-terminal XTEN | 1 | TPESGPGTSESATPESGPGSPAGSPTSTEEGTSESATPESGPG SEPATSGSETPGTSESATPESGPGTSTEPSEGSAPGTSTEPSE GSAPGTSTEPSEGSAPGTSTEPSEGSAPGTSTEPSEGSAPGTS TEPSEGSAPGSPAGSPTSTEEGTSTEPSEGSAPGTSESATPES GPGSEPATSGSETPGTSESATPESGPGSEPATSGSETPGTSES ATPESGPGTSTEPSEGSAPGTSESATPESGPGSPAGSPTSTEE GSPAGSPTSTEEGSPAGSPTSTEEGTSESATPESGPGTSTEPS EGSAPGTSESATPESGPGSEPATSGSETPGTSESATPESGPGS EPATSGSETPGTSESATPESGPGTSTEPSEGSAPGSPAGSPTS TEEGTSESATPESGPGSEPATSGSETPGTSESATPESGPGSPA GSPTSTEEGSPAGSPTSTEEGTSTEPSEGSAPGTSESATPESG PGTSESATPESGPGTSESATPESGPGSEPATSGSETPGSESAT SGSETPGSPAGSPTSTEEGTSTEPSEGSAPGTSTEPSEGSAPG SEPATSGSETPGTSESA | 576 |
| 8017 | C-terminal XTEN | 1 | GTSTEPSEGSAPGTSESATPESGPGSEPATSGSETPGSEPATS GSETPGSPAGSPTSTEEGTSESATPESGPGTSTEPSEGSAPGT STEPSEGSAPGSPAGSPTSTEEGTSTEPSEGSAPGTSTEPSEG SAPGTSESATPESGPGTSTEPSEGSAPGTSESATPESGPGSEP ATSGSETPGTSTEPSEGSAPGTSTEPSEGSAPGTSESATPESG PGTSESATPESGPGSPAGSPTSTEEGTSESATPESGPGSEPAT SGSETPGTSESATPESGPGTSTEPSEGSAPGTSTEPSEGSAPG TSTEPSEGSAPGTSTEPSEGSAPGTSTEPSEGSAPGTSTEPSE GSAPGSPAGSPTSTEEGTSTEPSEGSAPGTSESATPESGPGSE PATSGSETPGTSESATPESGPGSEPATSGSETPGTSESATPES GPGTSTEPSEGSAPGTSESASPESGPGSPAGSPTSTEEGSPAG SPTSTEEGSPAGSPTSTEEGTSESATPESGPGTSTEPSEGSAP GTSESATPESGPGSEPATSGSETPGTSESATPESGPGSEPATS GSETPGTSESATPESGP | 576 |
| 8018 | C-terminal XTEN | 1 | GSETPGSPAGSPTSTEEGTSESATPESGPGTSTEPSEGSAPGT STEPSEGSAPGSPAGSPTSTEEGTSTEPSEGSAPGTSTEPSEG SAPGTSESATPESGPGTSTEPSEGSAPGTSESATPESGPGSEP ATSGSETPGTSTEPSEGSAPGTSTEPSEGSAPGTSESATPESG PGTSESATPESGPGSPAGSPTSTEEGTSESATPESGPGSEPAT SGSETPGTSESATPESGPGTSTEPSEGSAPGTSTEPSEGSAPG TSTEPSEGSAPGTSTEPSEGSAPGTSTEPSEGSAPGTSTEPSE GSAPGSPAGSPTSTEEGTSTEPSEGSAPGTSESATPESGPGSE PATSGSETPGTSESATPESGPGSEPATSGSETPGTSESATPES GPGTSTEPSEGSAPGTSESATPESGPGSPAGSPTSTEEGSPAG SPTSTEEGSPAGSPTSTEEGTSESATPESGPGTSTEPSEGSAP | 576 |

TABLE 3a-continued

Exemplary Barcoded XTENs

| SEQ ID NO. | XTEN Type | # of Barcode(s) | Amino Acid Sequence | Total # of AAs |
|---|---|---|---|---|
| | | | GTSESATPESGPGSEPATSGSTETGTSESATPESGPGSEPAT SGSETPGTSESATPESGPGTSTEPSEGSAPGSPAGSPTSTEEG TSESATPESGPGSEPATS | |
| 8019 | C-terminal XTEN | 1 | EGSAPGTSTEPSEGSAPGTSESATPESGPGTSTEPSEGSAPGT SESATPESGPGSEPATSGSETPGTSTEPSEGSAPGTSTEPSEG SAPGTSESATPESGPGTSESATPESGPGSPAGSPTSTEEGTSE SATPESGPGSEPATSGSETPGTSESATPESGPGTSTEPSEGSA PGTSTEPSEGSAPGTSTEPSEGSAPGTSTEPSEGSAPGTSTEP SEGSAPGTSTEPSEGSAPGSPAGSPTSTEEGTSTEPSEGSAPG TSESATPESGPGSEPATSGSETPGTSESATPESGPGSEPATSG SETPGTSESATPESGPGTSTEPSEGSAPGTSESATPESGPGSP AGSPTSTEEGSPAGSPTSTEEGSPAGSPTSTEEGTSESATPES GPGTSTEPSEGSAPGTSESATPESGPGSEPATSGSETPGTSES ATPESGPGSEPATSGSETPGTSESASPESGPGTSTEPSEGSAP GSPAGSPTSTEEGTSESATPESGPGSEPATSGSETPGTSESAT PESGPGSPAGSPTSTEEGSPAGSPTSTEEGTSTEPSEGSAPGT SESATPESGPGTSESAT | 576 |
| 8020 | N-terminal XTEN | 1 | ASSPAGSPTSTESGTSESATPESGPGTSTEPSEGSAPGTSESA TPESGPGSEPATSGSETPGTSESATPESGPGSTPAESGSETPG TSESATPESGPGTSTEPSEGSAPGSPAGSPTSTEEGTSESATP ESGPGSEPATSGSETPGTSESATPESGPGSPAGSPTSTEEGSP AGSPTSTEEGTSTEPSEGSAPGTSESATPESGPGTSESATPES GPGTSESATPESGPGSEPATSGSETPGSEPATSGSETPGSPAG SPTSTEEGTSTEPSEGSAPGTSTEPSEGSAPGGSAP | 294 |

In some embodiments, a barcoded XTEN can be obtained by making one or more mutations to a general-purpose XTEN, such as any listed in Table 3b, according to one or more of the following criteria: to minimize the sequence change in the XTEN, to minimize the amino acid composition change in the XTEN, to substantially maintain the net charge of the XTEN, to substantially maintain (or improve) low immunogenicity of the XTEN, and to substantially maintain (or improve) the pharmacokinetic properties of the XTEN. In some embodiments, the XTEN sequence has at least 90%, at least 92%, at least 95%, at least 98%, at least 99%, or 10000 sequence identity to any one of SEQ ID NOs: 601-659 listed in Table 3b. In some embodiments, the XTEN sequence, having at least 90% (e.g., at least 92%, at least 95%, at least 98%, or at least 99%) but less than 100% sequence identity to any of SEQ ID NOs: 601-659 listed in Table 3b, is obtained by one or more mutations (e.g., less than 10, less than 8, less than 6, less than 5, less than 4, less than 3, less than 2 mutations) of the corresponding sequence from Table 3b. In some embodiments, the one or more mutations comprise deletion of a glutamic acid residue, insertion of a glutamic acid residue, substitution of a glutamic acid residue, or substitution for a glutamic acid residue, or any combination thereof. In some embodiments, where the XTEN sequence differs from, but has at least 90% (e.g., at least 92%, at least 95%, at least 98%, or at least 99%) sequence identity to, any one of SEQ ID NOs: 601-659 listed in Table 3b, at least 80%, at least 90%, at least 95%, at least 97%, or about 100% of the difference between the XTEN sequence and the corresponding sequence of Table 3b involve deletion of a glutamic acid residue, insertion of a glutamic acid residue, substitution of a glutamic acid residue, or substitution for a glutamic acid residue, or any combination thereof. In some such embodiments, at least 80%, at least 90%, at least 95%, at least 97%, or about 100% of the difference between the XTEN sequence and the corresponding sequence of Table 3b involve a substitution of a glutamic acid residue, or a substitution for a glutamic acid residue, or both. The term "a substitution of a first amino acid," as used herein, refers to replacement of the first amino acid residue for a second amino acid residue, resulting in the second amino acid residue taking place at the substitution position in the obtained sequence. For example, "a substitution of glutamic acid" refers to replacement of the glutamic acid (E) residue for a non-glutamic acid residue (e.g., serine (S)). The term "a substitution for a first amino acid," as used herein, refers to replacement of a second amino acid residue for the first amino acid residue, resulting in the first amino acid residue taking place at the substitution position in the obtained sequence. For example, "a substitution for glutamic acid" refers to replacement of a non-glutamic acid residue (e.g., serine (S)) for a glutamic acid residue.

TABLE 3b

Exemplary General-Purpose XTEN for Engineering into Barcoded XTEN(s)

| XTEN Name | Amino Acid Sequence | SEQ ID NO |
|---|---|---|
| AE144 | GSEPATSGSETPGTSESATPESGPGSEPATSGSETPGSPAGSPTSTEEGTSTEPSEGS APGSEPATSGSETPGSEPATSGSETPGSEPATSGSETPGTSTEPSEGSAPGTSESATP ESGPGSEPATSGSETPGTSTEPSEGSAP | 601 |

TABLE 3b-continued

Exemplary General-Purpose XTEN for Engineering into Barcoded XTEN(s)

| XTEN Name | Amino Acid Sequence | SEQ ID NO |
|---|---|---|
| AE144_1A | SPAGSPTSTEEGTSESATPESGPGTSTEPSEGSAPGSPAGSPTSTEEGTSTEPSEGSAP GTSTEPSEGSAPGTSESATPESGPGSEPATSGSETPGSEPATSGSETPGSPAGSPTST EEGTSESATPESGPGTSTEPSEGSAPG | 602 |
| AE144_2A | TSTEPSEGSAPGSPAGSPTSTEEGTSTEPSEGSAPGTSTEPSEGSAPGTSESATPESGP GTSTEPSEGSAPGTSESATPESGPGSEPATSGSETPGTSTEPSEGSAPGTSTEPSEGS APGTSESATPESGPGTSESATPESGPG | 603 |
| AE144_2B | TSTEPSEGSAPGSPAGSPTSTEEGTSTEPSEGSAPGTSTEPSEGSAPGTSESATPESGP GTSTEPSEGSAPGTSESATPESGPGSEPATSGSETPGTSTEPSEGSAPGTSTEPSEGS APGTSESATPESGPGTSESATPESGPG | 604 |
| AE144_3A | SPAGSPTSTEEGTSESATPESGPGSEPATSGSETPGTSESATPESGPGTSTEPSEGSAP GTSTEPSEGSAPGTSTEPSEGSAPGTSTEPSEGSAPGTSTEPSEGSAPGTSTEPSEGS APGSPAGSPTSTEEGTSTEPSEGSAPG | 605 |
| AE144_3B | SPAGSPTSTEEGTSESATPESGPGSEPATSGSETPGTSESATPESGPGTSTEPSEGSAP GTSTEPSEGSAPGTSTEPSEGSAPGTSTEPSEGSAPGTSTEPSEGSAPGTSTEPSEGS APGSPAGSPTSTEEGTSTEPSEGSAPG | 606 |
| AE144_4A | TSESATPESGPGSEPATSGSETPGTSESATPESGPGSEPATSGSETPGTSESATPESGP GTSTEPSEGSAPGTSESATPESGPGSPAGSPTSTEEGSPAGSPTSTEEGSPAGSPTST EEGTSESATPESGPGTSTEPSEGSAPG | 607 |
| AE144_4B | TSESATPESGPGSEPATSGSETPGTSESATPESGPGSEPATSGSETPGTSESATPESGP GTSTEPSEGSAPGTSESATPESGPGSPAGSPTSTEEGSPAGSPTSTEEGSPAGSPTST EEGTSESATPESGPGTSTEPSEGSAPG | 608 |
| AE144_5A | TSESATPESGPGSEPATSGSETPGTSESATPESGPGSEPATSGSETPGTSESATPESGP GTSTEPSEGSAPGSPAGSPTSTEEGTSESATPESGPGSEPATSGSETPGTSESATPES GPGSPAGSPTSTEEGSPAGSPTSTEEG | 609 |
| AE144_6B | TSTEPSEGSAPGTSESATPESGPGTSESATPESGPGTSESATPESGPGSEPATSGSETP GSEPATSGSETPGSPAGSPTSTEEGTSTEPSEGSAPGTSTEPSEGSAPGSEPATSGSE TPGTSESATPESGPGTSTEPSEGSAPG | 610 |
| AE288_1 | GTSESATPESGPGSEPATSGSETPGTSESATPESGPGSEPATSGSETPGTSESATPES GPGTSTEPSEGSAPGSPAGSPTSTEEGTSESATPESGPGSEPATSGSETPGTSESATP ESGPGSPAGSPTSTEEGSPAGSPTSTEEGTSTEPSEGSAPGTSESATPESGPGTSESA TPESGPGTSESATPESGPGSEPATSGSETPGSEPATSGSETPGSPAGSPTSTEEGTST EPSEGSAPGTSTEPSEGSAPGSEPATSGSETPGTSESATPESGPGTSTEPSEGSAP | 611 |
| AE288_2 | GSPAGSPTSTEEGTSESATPESGPGSEPATSGSETPGTSESATPESGPGTSTEPSEGS APGTSTEPSEGSAPGTSTEPSEGSAPGTSTEPSEGSAPGTSTEPSEGSAPGTSTEPSE GSAPGSPAGSPTSTEEGTSTEPSEGSAPGTSESATPESGPGSEPATSGSETPGTSESA TPESGPGSEPATSGSETPGTSESATPESGPGTSTEPSEGSAPGTSESATPESGPGSPA GSPTSTEEGSPAGSPTSTEEGSPAGSPTSTEEGTSESATPESGPGTSTEPSEGSAP | 612 |
| AE576 | GSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA TSGSETPGTSTEPSEGSAPGTSTEPSEGSAPGTSTEPSEGSAPGTSESATPESGPGSP AGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAPGTSTEPSEGSAP GSPAGSPTSTEEGTSTEPSEGSAPGTSESATPESGPGSEPATSGSETPGTSESATPES GPGSEPATSGSETPGTSESATPESGPGTSTEPSEGSAPGTSESATPESGPGSPAGSPT STEEGSPAGSPTSTEEGSPAGSPTSTEEGTSESATPESGPGTSTEPSEGSAP | 613 |
| AE624 | MAEPAGSPTSTEEGTPGSGTASSSPGSSTPSGATGSPGASPGTSSTGSPGSPAGSPTS TEEGTSESATPESGPGTSTEPSEGSAPGSPAGSPTSTEEGTSTEPSEGSAPGTSTEPSE GSAPGTSESATPESGPGSEPATSGSETPGSEPATSGSETPGSPAGSPTSTEEGTSESA TPESGPGTSTEPSEGSAPGTSTEPSEGSAPGSPAGSPTSTEEGTSTEPSEGSAPGTSTE PSEGSAPGTSESATPESGPGTSTEPSEGSAPGTSESATPESGPGSEPATSGSETPGT STEPSEGSAPGTSTEPSEGSAPGTSESATPESGPGTSESATPESGPGSPAGSPTSTEE GTSESATPESGPGSEPATSGSETPGTSESATPESGPGTSTEPSEGSAPGTSTEPSEGS APGTSTEPSEGSAPGTSTEPSEGSAPGTSTEPSEGSAPGTSTEPSEGSAPGSPAGSPT STEEGTSTEPSEGSAPGTSESATPESGPGSEPATSGSETPGTSESATPESGPGSEPAT SGSETPGTSESATPESGPGTSTEPSEGSAPGTSESATPESGPGSPAGSPTSTEEGSPA GSPTSTEEGSPAGSPTSTEEGTSESATPESGPGTSTEPSEGSAP | 614 |
| AE864 | GSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA | 615 |

TABLE 3b-continued

Exemplary General-Purpose XTEN for Engineering into Barcoded XTEN(s)

| XTEN Name | Amino Acid Sequence | SEQ ID NO |
|---|---|---|
| | TSGSETPGTSTEPSEGSAPGTSTEPSEGSAPGTSESATPESGPGTSESATPESGPGSP AGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAPGTSTEPSEGSAP GSSPAGSPTSTEEGTSTEPSEGSAPGTSESATPESGPGSEPATSGSETPGTSESATPES GPGSEPATSGSETPGTSESATPESGPGTSTEPSEGSAPGTSESATPESGPGSPAGSPT STEEGSPAGSPTSTEEGSPAGSPTSTEEGTSESATPESGPGTSTEPSEGSAPGTSESA TPESGPGSEPATSGSETPGTSESATPESGPGSEPATSGSETPGTSESATPESGPGTST EPSEGSAPGSPAGSPTSTEEGTSESATPESGPGSEPATSGSETPGTSESATPESGPGS PAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGS APGTSTEPSEGSAPGSEPATSGSETPGTSESATPESGPGTSTEPSEGSAP | |
| AE865 | GGSPAGSPTSTEEGTSESATPESGPGTSTEPSEGSAPGSPAGSPTSTEEGTSTEPSEG SAPGTSTEPSEGSAPGTSESATPESGPGSEPATSGSETPGSEPATSGSETPGSPAGSP TSTEEGTSESATPESGPGTSTEPSEGSAPGTSTEPSEGSAPGSPAGSPTSTEEGTSTEP SEGSAPGTSTEPSEGSAPGTSESATPESGPGTSTEPSEGSAPGTSESATPESGPGSEP ATSGSETPGTSTEPSEGSAPGTSTEPSEGSAPGTSESATPESGPGTSESATPESGPGS PAGSPTSTEEGTSESATPESGPGSEPATSGSETPGTSESATPESGPGTSTEPSEGSAP GTSTEPSEGSAPGTSTEPSEGSAPGTSTEPSEGSAPGTSTEPSEGSAPGTSTEPSEGS APGSPAGSPTSTEEGTSTEPSEGSAPGTSTEPSEGSAPGSPAGSPTSTEEGTSESATP ESGPGSEPATSGSETPGTSESATPESGPGTSTEPSEGSAPGTSESATPESGPGSPAGS PTSTEEGSPAGSPTSTEEGSPAGSPTSTEEGTSESATPESGPGTSTEPSEGSAPGTSES ATPESGPGSEPATSGSETPGTSESATPESGPGSEPATSGSETPGTSESATPESGPGTS TEPSEGSAPGSPAGSPTSTEEGTSESATPESGPGSEPATSGSETPGTSESATPESGPG SPAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGS APGTSTEPSEGSAPGSEPATSGSETPGTSESATPESGPGTSTEPSEGSAP | 616 |
| AE866 | PGSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSESATPESGPGSP AGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAPGTSTEPSEGSAP GSPAGSPTSTEEGTSTEPSEGSAPGTSTEPSEGSAPGSPAGSPTSTEEGTSESATPES GPGSEPATSGSETPGTSESATPESGPGTSTEPSEGSAPGTSESATPESGPGSPAGSPT STEEGSPAGSPTSTEEGSPAGSPTSTEEGTSESATPESGPGTSTEPSEGSAPGTSESA TPESGPGSEPATSGSETPGTSESATPESGPGSEPATSGSETPGTSESATPESGPGTST EPSEGSAPGSPAGSPTSTEEGTSESATPESGPGSEPATSGSETPGTSESATPESGPGS PAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGS APGTSTEPSEGSAPGSEPATSGSETPGTSESATPESGPGTSTEPSEGSAPG | 617 |
| AE1152 | GSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSESATPESGPGSP AGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAPGTSTEPSEGSAP GSPAGSPTSTEEGTSTEPSEGSAPGTSTEPSEGSAPGSPAGSPTSTEEGTSESATPES GPGSEPATSGSETPGTSESATPESGPGTSTEPSEGSAPGTSESATPESGPGSPAGSPT STEEGSPAGSPTSTEEGSPAGSPTSTEEGTSESATPESGPGTSTEPSEGSAPGTSESA TPESGPGSEPATSGSETPGTSESATPESGPGSEPATSGSETPGTSESATPESGPGTST EPSEGSAPGSPAGSPTSTEEGTSESATPESGPGSEPATSGSETPGTSESATPESGPGS PAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGS APGTSTEPSEGSAPGSEPATSGSETPGTSESATPESGPGTSTEPSEGSAPGTSESATP ESGPGSEPATSGSETPGTSESATPESGPGSEPATSGSETPGTSESATPESGPGTSTEPS EGSAPGSPAGSPTSTEEGTSESATPESGPGSEPATSGSETPGTSESATPESGPGSPAG SPTSTEEGSPAGSPTSTEEGTSTEPSEGSAPGTSESATPESGPGTSE SATPESGPGSEPATSGSETPGSEPATSGSETPGSPAGSPTSTEEGTSTEPSEGSAPGT STEPSEGSAPGSEPATSGSETPGTSESATPESGPGTSTEPSEGSAP | 618 |
| AE144A | STEPSEGSAPGSPAGSPTSTEEGTSTEPSEGSAPGTSESATPESGPGSEPATSGSETP GTSESATPESGPGSEPATSGSETPGTSESATPESGPGTSTEPSEGSAPGTSESATPES GPGSPAGSPTSTEEGSPAGSPTSTEEGS | 619 |
| AE144B | SEPATSGSETPGTSESATPESGPGSEPATSGSETPGTSESATPESGPGTSTEPSEGSAP GSPAGSPTSTEEGTSESATPESGPGSEPATSGSETPGTSESATPESGPGSPAGSPTST EEGSPAGSPTSTEEGTSTEPSEGSAPG | 620 |

TABLE 3b-continued

Exemplary General-Purpose XTEN for Engineering into Barcoded XTEN(s)

| XTEN Name | Amino Acid Sequence | SEQ ID NO |
|---|---|---|
| AE180A | TSTEEGTSESATPESGPGSEPATSGSETPGTSESATPESGPGSPAGSPTSTEEGSPAG SPTSTEEGTSTEPSEGSAPGTSESATPESGPGTSESATPESGPGTSESATPESGPGSEP ATSGSETPGSEPATSGSETPGSPAGSPTSTEEGTSTEPSEGSAPGTSTEPSEGSAPGS EPATS | 621 |
| AE216A | PESGPGTSTEPSEGSAPGSPAGSPTSTEEGTSESATPESGPGSEPATSGSETPGTSES ATPESGPGSPAGSPTSTEEGSPAGSPTSTEEGTSTEPSEGSAPGTSESATPESGPGTS ESATPESGPGTSESATPESGPGSEPATSGSETPGSEPATSGSETPGSPAGSPTSTEEG TSTEPSEGSAPGTSTEPSEGSAPGSEPATSGSETPGTSESAT | 622 |
| AE252A | ESGPGSEPATSGSETPGTSESATPESGPGTSTEPSEGSAPGSPAGSPTSTEEGTSESA TPESGPGSEPATSGSETPGTSESATPESGPGSPAGSPTSTEEGSPAGSPTSTEEGTST EPSEGSAPGTSESATPESGPGTSESATPESGPGTSESATPESGPGSEPATSGSETPGS EPATSGSETPGSPAGSPTSTEEGTSTEPSEGSAPGTSTEPSEGSAPGSEPATSGSETP GTSESATPESGPGTSTEPSE | 623 |
| AE288A | TPESGPGTSTEPSEGSAPGTSESATPESGPGSEPATSGSETPGTSESATPESGPGSEP ATSGSETPGTSESATPESGPGTSTEPSEGSAPGSPAGSPTSTEEGTSESATPESGPGS EPATSGSETPGTSESATPESGPGSPAGSPTSTEEGSPAGSPTSTEEGTSTEPSEGSAP GTSESATPESGPGTSESATPESGPGSEPATSGSETPGSEPATSGSE TPGSPAGSPTSTEEGTSTEPSEGSAPGTSTEPSEGSAPGSEPATSGSETPGTSESA | 624 |
| AE324A | PESGPGSPAGSPTSTEEGSPAGSPTSTEEGSPAGSPTSTEEGTSESATPESGPGTSTEP SEGSAPGTSESATPESGPGSEPATSGSETPGTSESATPESGPGSEPATSGSETPGT SESATPESGPGTSTEPSEGSAPGSPAGSPTSTEEGTSESATPESGPGSEPATSGSETPGT SESATPESGPGSPAGSPTSTEEGSPAGSPTSTEEGTSTEPSEGSAPGTSESATPESGP GTSESATPESGPGTSESATPESGPGSEPATSGSETPGSEPATSGSETPGSPAGSPTST EEGTSTEPSEGSAPGTSTEPSEGSAPGSEPATS | 625 |
| AE360A | PESGPGTSTEPSEGSAPGTSESATPESGPGSPAGSPTSTEEGSPAGSPTSTEEGSPAG SPTSTEEGTSESATPESGPGTSTEPSEGSAPGTSESATPESGPGSEPATSGSETPGTSE SATPESGPGSEPATSGSETPGTSESATPESGPGTSTEPSEGSAPGSPAGSPTSTEEGT SESATPESGPGSEPATSGSETPGTSESATPESGPGSPAGSPTSTEEGSPAGSPTSTEE GTSTEPSEGSAPGTSESATPESGPGTSESATPESGPGTSESATPESGPGSEPATSGSE TPGSEPATSGSETPGSPAGSPTSTEEGTSTEPSEGSAPGTSTEPSEGSAPGSEPATSG SETPGTSESAT | 626 |
| AE396A | PESGPGSEPATSGSETPGTSESATPESGPGTSTEPSEGSAPGTSESATPESGPGSPAG SPTSTEEGSPAGSPTSTEEGSPAGSPTSTEEGTSESATPESGPGTSTEPSEGSAPGTSE SATPESGPGSEPATSGSETPGTSESATPESGPGSEPATSGSETPGTSESATPESGPGT STEPSEGSAPGSPAGSPTSTEEGTSESATPESGPGSEPATSGSETPGTSESATPESGP GSPAGSPTSTEEGSPAGSPTSTEEGTSTEPSEGSAPGTSESATPESGPGTSESATPES GPGTSESATPESGPGSEPATSGSETPGSEPATSGSETPGSPAGSPTSTEEGTSTEPSE GSAPGTSTEPS | 627 |
| AE432A | EGSAPGSPAGSPTSTEEGTSTEPSEGSAPGTSESATPESGPGSEPATSGSETPGTSES ATPESGPGSEPATSGSETPGTSESATPESGPGTSTEPSEGSAPGTSESATPESGPGSP AGSPTSTEEGSPAGSPTSTEEGSPAGSPTSTEEGTSESATPESGPGTSTEPSEGSAPG TSESATPESGPGSEPATSGSETPGTSESATPESGPGSEPATSGSETPGTSESATPESGP GTSTEPSEGSAPGSPAGSPTSTEEGTSESATPESGPGSEPATSGSETPGTSESATPES GPGSPAGSPTSTEEGSPAGSPTSTEEGTSTEPSEGSAPGTSESATPESGPGTSESATP ESGPGTSESATPESGPGSEPATSGSETPGSEPATSGSETPGSPAGSPTSTEEGTSTEPS EGSAPGTSTEPSEGSAPGSEPATS | 628 |
| AE468A | EGSAPGTSTEPSEGSAPGTSTEPSEGSAPGSPAGSPTSTEEGTSTEPSEGSAPGTSES ATPESGPGSEPATSGSETPGTSESATPESGPGSEPATSGSETPGTSESATPESGPGTS TEPSEGSAPGTSESATPESGPGSPAGSPTSTEEGSPAGSPTSTEEGSPAGSPTSTEEG TSESATPESGPGTSTEPSEGSAPGTSESATPESGPGSEPATSGSETPGTSESATPESGP GSEPATSGSETPGTSESATPESGPGTSTEPSEGSAPGSPAGSPTSTEEGTSESATPES GPGSEPATSGSETPGTSESATPESGPGSPAGSPTSTEEGSPAGSPTSTEEGTSTEPSE GSAPGTSESATPESGPGTSESATPESGPGTSESATPESGPGSEPATSGSETPGSEPAT SGSETPGSPAGSPTSTEEGTSTEPSEGSAPGTSTEPSEGSAPGSEPATSGSETPGTSES AT | 629 |
| AE504A | EGSAPGTSTEPSEGSAPGTSTEPSEGSAPGTSTEPSEGSAPGTSTEPSEGSAPGSPAG SPTSTEEGTSTEPSEGSAPGTSESATPESGPGSEPATSGSETPGTSESATPESGPGSEP ATSGSETPGTSESATPESGPGTSTEPSEGSAPGTSESATPESGPGSPAGSPTSTEEGS PAGSPTSTEEGSPAGSPTSTEEGTSESATPESGPGTSTEPSEGSAPGTSESATPESGP GSEPATSGSETPGTSESATPESGPGSEPATSGSETPGTSESATPESGPGTSTEPSEGS APGSPAGSPTSTEEGTSESATPESGPGSEPATSGSETPGTSESATPESGPGSPAGSPT STEEGSPAGSPTSTEEGTSTEPSEGSAPGTSESATPESGPGTSESATPESGPGTSESA TPESGPGSEPATSGSETPGSEPATSGSETPGSPAGSPTSTEEGTSTEPSEGSAPGTST EPSEGSAPGSEPATSGSETPGTSESATPESGPGTSTEPS | 630 |

TABLE 3b-continued

Exemplary General-Purpose XTEN for Engineering into Barcoded XTEN(s)

| XTEN Name | Amino Acid Sequence | SEQ ID NO |
|---|---|---|
| AE540A | TPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSEPTGTSESATPESGPGSEPATSGSETPGTSESATPESGPGTSTEPSEGSAPGTSESATPESGPGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEP | 631 |
| AE576A | TPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA | 632 |
| AE612A | GSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT | 633 |
| AE648A | PESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT | 634 |
| AE684A | EGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGSEPATSGSETPGSEPATSGSETPGSPAGSPTSTEEGTSTEPSEGSAPGTSTEPSEGSAPGSEPATS | 635 |
| AE720A | TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTE | 636 |

TABLE 3b-continued

Exemplary General-Purpose XTEN for Engineering into Barcoded XTEN(s)

| XTEN Name | Amino Acid Sequence | SEQ ID NO |
|---|---|---|
| AE756A | TSGSETPGSEPATSGSETPGSPAGSPTSTEEGTSESATPESGPGTSTEPSEGSAPGTS TEPSEGSAPGSPAGSPTSTEEGTSTEPSEGSAPGTSTEPSEGSAPGTSESATPESGPG TSTEPSEGSAPGTSESATPESGPGSEPATSGSETPGTSTEPSEGSAPGTSTEPSEGSAP GTSESATPESGPGTSESATPESGPGSPAGSPTSTEEGTSESATPESGPGSEPATSGSE TPGTSESATPESGPGTSTEPSEGSAPGTSTEPSEGSAPGTSTEPSEGSAPGTSTEPSE GSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTST EPSEGSAPGTSESATPESGPGSPAGSPTSTEEGSPAGSPTSTEEGSPAGSPTSTEEGT SESATPESGPGTSTEPSEGSAPGTSESATPESGPGSEPATSGSETPGTSESATPESGP GSEPATSGSETPGTSESATPESGPGTSTEPSEGSAPGSPAGSPTSTEEGTSESATPES GPGSEPATSGSETPGTSESATPESGPGSPAGSPTSTEEGSPAGSPTSTEEGTSTEPSE GSAPGTSESATPESGPGTSESATPESGPGTSESATPESGPGSEPATSGSETPGSEPAT SGSETPGSPAGSPTSTEEGTSTEPSEGSAPGTSTEPSEGSAPGSEPATSGSETPGTSES | 637 |
| AE792A | EGSAPGTSESATPESGPGSEPATSGSETPGSEPATSGSETPGSPAGSPTSTEEGTSES ATPESGPGTSTEPSEGSAPGTSTEPSEGSAPGSPAGSPTSTEEGTSTEPSEGSAPGTS TEPSEGSAPGTSESATPESGPGTSTEPSEGSAPGTSESATPESGPGSEPATSGSETPG TSTEPSEGSAPGTSTEPSEGSAPGTSESATPESGPGTSESATPESGPGSPAGSPTSTEE GTSESATPESGPGSEPATSGSETPGTSESATPESGPGTSTEPSEGSAPGTSTEPSEGS APGTSTEPSEGSAPGTSTEPSEGSAPGTSTEPSEGSAPGTSTEPSEGSAPGSPAGSPT STEEGTSTEPSEGSAPGTSESATPESGPGSEPATSGSETPGTSESATPESGPGSEPAT SGSETPGTSESATPESGPGTSTEPSEGSAPGTSESATPESGPGSPAGSPTSTEEGSPA GSPTSTEEGSPAGSPTSTEEGTSESATPESGPGTSTEPSEGSAPGTSESATPESGPGS EPATSGSETPGTSESATPESGPGSEPATSGSETPGTSESATPESGPGTSTEPSEGSAP GSPAGSPTSTEEGTSESATPESGPGSEPATSGSETPGTSESATPESGPGSPAGSPTST EEGSPAGSPTSTEEGTSTEPSEGSAPGTSESATPESGPGTSESATPESGPGTSESATP ESGPGSEPATSGSETPGSEPATSGSETPGSPAGSPTSTEEGTSTEPSEGSAPGTSTEPS EGSAPGSEPATSGSETPGTSESATPESGPGTSTEPS | 638 |
| AE828A | PESGPGTSTEPSEGSAPGSPAGSPTSTEEGTSTEPSEGSAPGTSTEPSEGSAPGTSES ATPESGPGSEPATSGSETPGSEPATSGSETPGSPAGSPTSTEEGTSESATPESGPGTS TEPSEGSAPGTSTEPSEGSAPGSPAGSPTSTEEGTSTEPSEGSAPGTSTEPSEGSAPG TSESATPESGPGTSTEPSEGSAPGTSESATPESGPGSEPATSGSETPGTSTEPSEGSAP GTSTEPSEGSAPGTSESATPESGPGTSESATPESGPGSPAGSPTSTEEGTSESATPES GPGSEPATSGSETPGTSESATPESGPGTSTEPSEGSAPGTSTEPSEGSAPGTSTEPSE GSAPGTSTEPSEGSAPGTSTEPSEGSAPGTSTEPSEGSAPGSPAGSPTSTEEGTSTEP SEGSAPGTSESATPESGPGSEPATSGSETPGTSESATPESGPGSEPATSGSETPGTSE SATPESGPGTSTEPSEGSAPGTSESATPESGPGSPAGSPTSTEEGSPAGSPTSTEEGS PAGSPTSTEEGTSESATPESGPGTSTEPSEGSAPGTSESATPESGPGSEPATSGSETP GTSESATPESGPGSEPATSGSETPGTSESATPESGPGTSTEPSEGSAPGSPAGSPTST EEGTSESATPESGPGSEPATSGSETPGTSESATPESGPGSPAGSPTSTEEGSPAGSPT STEEGTSTEPSEGSAPGTSESATPESGPGTSESATPESGPGTSESATPESGPGSEPAT SGSETPGSEPATSGSETPGSPAGSPTSTEEGTSTEPSEGSAPGTSTEPSEGSAPGSEP ATSGSETPGTSESAT | 639 |
| AE869 | GSPGSPAGSPTSTEEGTSESATPESGPGTSTEPSEGSAPGSPAGSPTSTEEGTSTEPSE GSAPGTSTEPSEGSAPGTSESATPESGPGSEPATSGSETPGSEPATSGSETPGSPAGS PTSTEEGTSESATPESGPGTSTEPSEGSAPGTSTEPSEGSAPGSPAGSPTSTEEGTSTE PSEGSAPGTSTEPSEGSAPGTSESATPESGPGTSTEPSEGSAPGTSESATPESGPGSE PATSGSETPGTSTEPSEGSAPGTSTEPSEGSAPGTSESATPESGPGTSESATPESGPG SPAGSPTSTEEGTSESATPESGPGSEPATSGSETPGTSESATPESGPGTSTEPSEGSAP GTSTEPSEGSAPGTSTEPSEGSAPGTSTEPSEGSAPGTSTEPSEGSAPGTSTEPSEGS APGSPAGSPTSTEEGTSTEPSEGSAPGTSESATPESGPGSEPATSGSETPGTSESATP ESGPGSEPATSGSETPGTSESATPESGPGTSTEPSEGSAPGTSESATPESGPGSPAGS PTSTEEGSPAGSPTSTEEGSPAGSPTSTEEGTSESATPESGPGTSTEPSEGSAPGTSES ATPESGPGSEPATSGSETPGTSESATPESGPGSEPATSGSETPGTSESATPESGPGTS TEPSEGSAPGSPAGSPTSTEEGTSESATPESGPGSEPATSGSETPGTSESATPESGPG SPAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGS APGTSTEPSEGSAPGSEPATSGSETPGTSESATPESGPGTSTEPSEGSAPGR | 640 |
| AE144_R1 | SAGSPGSPAGSPTSTEEGTSESATPESGPGTSTEPSEGSAPGSPAGSPTSTEEGTSTE PSEGSAPGTSTEPSEGSAPGTSESATPESGPGSEPATSGSETPGSEPATSGSETPGSP AGSPTSTEEGTSESATPESGPGTESASR | 641 |
| AE288_R1 | SAGSPTGPGSEPATSGSETPGTSESATPESGPGSEPATSGSETPGTSESATPESGPGT STEPSEGSAPGSPAGSPTSTEEGTSESATPESGPGSEPATSGSETPGTSESATPESGP GSPAGSPTSTEEGSPAGSPTSTEEGTSTEPSEGSAPGTSESATPESGPGTSESATPES GPGTSESATPESGPGSEPATSGSETPGSEPATSGSETPGSPAGSPTSTEEGTSTEPSE GSAPGTSTEPSEGSAPGSEPATSGSETPGTSESATPESGPGTSTEPSEGSAPSASR | 642 |
| AE432_R1 | SAGSPGSPAGSPTSTEEGTSESATPESGPGTSTEPSEGSAPGSPAGSPTSTEEGTSTE PSEGSAPGTSTEPSEGSAPGTSESATPESGPGSEPATSGSETPGSEPATSGSETPGSP AGSPTSTEEGTSESATPESGPGTSTEPSEGSAPGTSTEPSEGSAPGSPAGSPTSTEEG | 643 |

TABLE 3b-continued

Exemplary General-Purpose XTEN for Engineering into Barcoded XTEN(s)

| XTEN Name | Amino Acid Sequence | SEQ ID NO |
|---|---|---|
| | TSTEPSEGSAPGTSTEPSEGSAPGTSESATPESGPGTSTEPSEGSAPGTSESATPESGP GSEPATSGSETPGTSTEPSEGSAPGTSTEPSEGSAPGTSESATPESGPGTSESATPES GPGSPAGSPTSTEEGTSESATPESGPGSEPATSGSETPGTSESATPESGPGTSTEPSE GSAPGTSTEPSEGSAPGTSTEPSEGSAPGTSTEPSEGSAPGTSTEP SEGSAPGSPAGSPTSTEEGTESASR | |
| AE576_R1 | SAGSPTEEGTSESATPESGPGSEPATSGSETPGTSESATPESGPGTSTEPSEGSAPGT STEPSEGSAPGTSTEPSEGSAPGTSTEPSEGSAPGTSTEPSEGSAPGTSTEPSEGSAP GSPAGSPTSTEEGTSTEPSEGSAPGTSESATPESGPGSEPATSGSETPGTSESATPES GPGSEPATSGSETPGTSESATPESGPGTSTEPSEGSAPGTSESATPESGPGSPAGSPT STEEGSPAGSPTSTEEGSPAGSPTSTEEGTSESATPESGPGTSTEPSEGSAPGTSESA TPESGPGSEPATSGSETPGTSESATPESGPGSEPATSGSETPGTSESATPESGPGTST EPSEGSAPGSPAGSPTSTEEGTSESATPESGPGSEPATSGSETPGTSESATPESGPGS PAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGS APGTSTEPSEGSAPGSEPATSGSETPGTSESATPESGPGTSTEPSEGSAPSASR | 644 |
| AE864_R1 | SAGSPGSPAGSPTSTEEGTSESATPESGPGTSTEPSEGSAPGSPAGSPTSTEEGTSTE PSEGSAPGTSTEPSEGSAPGTSESATPESGPGSEPATSGSETPGSEPATSGSETPGSP AGSPTSTEEGTSESATPESGPGTSTEPSEGSAPGTSTEPSEGSAPGSPAGSPTSTEEG TSTEPSEGSAPGTSTEPSEGSAPGTSESATPESGPGTSTEPSEGSAPGTSESATPESGP GSEPATSGSETPGTSTEPSEGSAPGTSTEPSEGSAPGTSESATPESGPGTSESATPES GPGSPAGSPTSTEEGTSESATPESGPGSEPATSGSETPGTSESATPESGPGTSTEPSE GSAPGTSTEPSEGSAPGTSTEPSEGSAPGTSTEPSEGSAPGTSTEP SEGSAPGSPAGSPTSTEEGTSTEPSEGSAPGTSESATPESGPGSEPATSGSETPGTSE SATPESGPGSEPATSGSETPGTSESATPESGPGTSTEPSEGSAPGTSESATPESGPGS PAGSPTSTEEGSPAGSPTSTEEGSPAGSPTSTEEGTSESATPESGPGTSTEPSEGSAP GTSESATPESGPGSEPATSGSETPGTSESATPESGPGSEPATSGSETPGTSESATPES GPGTSTEPSEGSAPGSPAGSPTSTEEGTSESATPESGPGSEPATSGSETPGTSESATP ESGPGSPAGSPTSTEEGSPAGSPTSTEEGTSTEPSEGSAPGTSESATPESGPGTSESA TPESGPGTSESATPESGPGSEPATSGSETPGSEPATSGSETPGSPAGSPTSTEEGTST EPSEGSAPGTSTEPSEGSAPGSEPATSGSETPGTSESATPESGPGTESASR | 645 |
| AE712 | PGSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSESATPESGPGSP AGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAPGTSTEPSEGSAP GSPAGSPTSTEEGTSTEPSEGSAPGTSESATPESGPGSEPATSGSETPGTSESATPES GPGSEPATSGSETPGTSESATPESGPGTSTEPSEGSAPGTSESATPESGPGSPAGSPT STEEGSPAGSPTSTEEGSPAGSPTSTEEGTSESATPESGPGTSTEPSEGSAPGTSESA TPESGPGSEPATSGSETPGTSESATPESGPGSEPATSGSETPGTSESATPESGPGTST EPSEGSAPGSPAGSPTSTEEGTSESATPESGPGSEPATSGSETPGTSESATPESGPGS PAGSPTSTEAHHH | 646 |
| AE864_R2 | GSPGAGSPAGSPTSTEEGTSESATPESGPGTSTEPSEGSAPGSPAGSPTSTEEGTSTE PSEGSAPGTSTEPSEGSAPGTSESATPESGPGSEPATSGSETPGSEPATSGSETPGSP AGSPTSTEEGTSESATPESGPGTSTEPSEGSAPGTSTEPSEGSAPGSPAGSPTSTEEG TSTEPSEGSAPGTSTEPSEGSAPGTSESATPESGPGTSTEPSEGSAPGTSESATPESGP GSEPATSGSETPGTSTEPSEGSAPGTSTEPSEGSAPGTSESATPESGPGTSESATPES GPGSPAGSPTSTEEGTSESATPESGPGSEPATSGSETPGTSESATPESGPGTSTEPSE GSAPGTSTEPSEGSAPGTSTEPSEGSAPGTSTEPSEGSAPGTSTEPSEGSAPGTSTEP SEGSAPGSPAGSPTSTEEGTSTEPSEGSAPGTSESATPESGPGSEPATSGSETPGTSE SATPESGPGSEPATSGSETPGTSESATPESGPGTSTEPSEGSAPGTSESATPESGPGS PAGSPTSTEEGSPAGSPTSTEEGSPAGSPTSTEEGTSESATPESGPGTSTEPSEGSAP GTSESATPESGPGSEPATSGSETPGTSESATPESGPGSEPATSGSETPGTSESATPES GPGTSTEPSEGSAPGSPAGSPTSTEEGTSESATPESGPGSEPATSGSETPGTSESATP ESGPGSPAGSPTSTEEGSPAGSPTSTEEGTSTEPSEGSAPGTSESATPESGPGTSESA TPESGPGTSESATPESGPGSEPATSGSETPGSEPATSGSETPGSPAGSPTSTEEGTST EPSEGSAPGTSTEPSEGSAPGSEPATSGSETPGTSESATPESGPGTESASR | 647 |
| AE288_3 | SPAGSPTSTEEGTSESATPESGPGTSTEPSEGSAPGTSESATPESGPGSEPATSGSETP GTSESATPESGPGSEPATSGSETPGTSESATPESGPGTSTEPSEGSAPGSPAGSPTST EEGTSESATPESGPGSEPATSGSETPGTSESATPESGPGSPAGSPTSTEEGSPAGSPT STEEGTSTEPSEGSAPGTSESATPESGPGTSESATPESGPGTSESATPESGPGSEPAT SGSETPGSEPATSGSETPGSPAGSPTSTEEGTSTEPSEGSAPGTSTEPSEGSAPG | 648 |
| AE284 | GTSESATPESGPGSEPATSGSETPGTSESATPESGPGSEPATSGSETPGTSESATPES GPGTSTEPSEGSAPGSPAGSPTSTEEGTSESATPESGPGSEPATSGSETPGTSESATP ESGPGSPAGSPTSTEEGSPAGSPTSTEEGTSTEPSEGSAPGTSESATPESGPGTSESA TPESGPGTSESATPESGPGSEPATSGSETPGSEPATSGSETPGSPAGSPTSTEEGTST EPSEGSAPGTSTEPSEGSAPGSEPATSGSETPGTSESATPESGPGTSTEPSE | 649 |

TABLE 3b-continued

Exemplary General-Purpose XTEN for Engineering into Barcoded XTEN(s)

| XTEN Name | Amino Acid Sequence | SEQ ID NO |
|---|---|---|
| AE292 | SPAGSPTSTEEGTSESATPESGPGTSTEPSEGSAPGTSESATPESGPGSEPATSGSETP GTSESATPESGPGSEPATSGSETPGTSESATPESGPGTSTEPSEGSAPGSPAGSPTSTE EGTSESATPESGPGSEPATSGSETPGTSESATPESGPGSPAGSPTSTEEGSPAGSPT STEEGTSTEPSEGSAPGTSESATPESGPGTSESATPESGPGTSESATPESGPGSEPAT SGSETPGSEPATSGSETPGSPAGSPTSTEEGTSTEPSEGSAPGTSTEPSEGSAPGGSA P | 650 |
| AE864_2 | AGSPTSTEEGTSESATPESGPGTSTEPSEGSAPGSPAGSPTSTEEGTSTEPSEGSAPG TSTEPSEGSAPGTSESATPESGPGSEPATSGSETPGSEPATSGSETPGSPAGSPTSTEE GTSESATPESGPGTSTEPSEGSAPGTSTEPSEGSAPGSPAGSPTSTEEGTSTEPSEGS APGTSTEPSEGSAPGTSESATPESGPGTSTEPSEGSAPGTSESATPESGPGSEPATSG SETPGTSTEPSEGSAPGTSTEPSEGSAPGTSESATPESGPGSPAGS PTSTEEGTSESATPESGPGSEPATSGSETPGTSESATPESGPGTSTEPSEGSAPGTSTE PSEGSAPGTSTEPSEGSAPGTSTEPSEGSAPGTSTEPSEGSAPGTSTEPSEGSAPGSP AGSPTSTEEGTSTEPSEGSAPGTSESATPESGPGSEPATSGSETPGTSESATPESGPG SEPATSGSETPGSEPATSGSETPGSPAGSPTSTEE GSPAGSPTSTEEGSPAGSPTSTEEGTSESATPESGPGTSTEPSEGSAPGTSESATPES GPGSEPATSGSETPGTSESATPESGPGSEPATSGSETPGTSESATPESGPGTSTEPSE GSAPGSPAGSPTSTEEGTSESATPESGPGSEPATSGSETPGTSESATPESGPGSPAGS PTSTEEGSPAGSPTSTEEGTSTEPSEGSAPGTSESATPESGPGTSESATPESGPGTSES ATPESGPGSEPATSGSETPGSEPATSGSETPGSPAGSPTSTEEGTSTEPSEGSAPGTS TEPSEGSAPGSEPATSGSETPGTSESATPESGPGTSTEPSEGAAEPEA | 651 |
| AE867 | GSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSTEPSEGSAPGSP AGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAPGTSTEPSEGSAP GSPAGSPTSTEEGTSTEPSEGSAPGTSESATPESGPGSEPATSGSETPGTSESATPES GPGSEPATSGSETPGTSESATPESGPGTSTEPSEGSAPGTSESATPESGPGSPAGSPT STEEGSPAGSPTSTEEGSPAGSPTSTEEGTSESATPESGPGTSTEPSEGSAPGTSESA TPESGPGSEPATSGSETPGTSESATPESGPGSEPATSGSETPGTSESATPESGPGTSTE PSEGSAPGSPAGSPTSTEEGTSESATPESGPGSEPATSGSETPGTSESATPESGPGS PAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGS APGTSTEPSEGSAPGSEPATSGSETPGTSESATPESGPGTSTEPSEGAAEPEA | 652 |
| AE867_2 | SPGSPAGSPTSTEEGTSESATPESGPGTSTEPSEGSAPGSPAGSPTSTEEGTSTEPSEG SAPGTSTEPSEGSAPGTSESATPESGPGSEPATSGSETPGSEPATSGSETPGSPAGSP TSTEEGTSESATPESGPGTSTEPSEGSAPGTSTEPSEGSAPGSPAGSPTSTEEGTSTEP SEGSAPGTSTEPSEGSAPGTSESATPESGPGTSTEPSEGSAPGTSESATPESGPGSEP ATSGSETPGTSTEPSEGSAPGTSTEPSEGSAPGTSESATPESGPGTSTEPSEGSPGPS PAGSPTSTEEGTSESATPESGPGSEPATSGSETPGTSESATPESGPGTSTEPSEGSAP GTSTEPSEGSAPGTSTEPSEGSAPGTSTEPSEGSAPGTSTEPSEGS APGSPAGSPTSTEEGTSTEPSEGSAPGTSESATPESGPGSEPATSGSETPGTSESATP ESGPGSEPATSGSETPGTSESATPESGPGTSTEPSEGSAPGTSESATPESGPGSPAGS PTSTEEGSPAGSPTSTEEGTSESATPESGPGTSTEPSEGSAPGTSES ATPESGPGSEPATSGSETPGTSESATPESGPGSEPATSGSETPGTSESATPESGPGTS TEPSEGSAPGSPAGSPTSTEEGTSESATPESGPGSEPATSGSETPGTSESATPESGPG SPAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGS APGTSTEPSEGSAPGSEPATSGSETPGTSESATPESGPGTSTEPSEGSAPG | 653 |
| AE868 | PGSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSTEPSEGSPGSP AGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAP GSPAGSPTSTEEGTSTEPSEGSAPGTSESATPESGPGSEPATSGSETPGTSESATPES GPGSEPATSGSETPGTSESATPESGPGTSTEPSEGSAPGTSESATPESGPGSPAGSPT STEEGSPAGSPTSTEEGSPAGSPTSTEEGTSESATPESGPGTSTEPSEGSAPGTSESA TPESGPGSEPATSGSETPGTSESATPESGPGSEPATSGSETPGTSESATPESGPGTST EPSEGSAPGSPAGSPTSTEEGTSESATPESGPGSEPATSGSETPGTSESATPESGPGS PAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGS APGTSTEPSEGSAPGSEPATSGSETPGTSESATPESGPGTSTEPSEGAAEPEA | 654 |
| AE144_7A | GSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAP | 655 |

TABLE 3b-continued

Exemplary General-Purpose XTEN for Engineering into Barcoded XTEN(s)

| XTEN Name | Amino Acid Sequence | SEQ ID NO |
|---|---|---|
| AE292 | SPAGSPTSTEEGTSESATPESGPGTSTEPSEGSAPGTSESATPESGPGSEPATSGSETP GTSESATPESGPGSEPATSGSETPGTSESATPESGPGTSTEPSEGSAPGSPAGSPTST EEGTSESATPESGPGSEPATSGSETPGTSESATPESGPGSPAGSPTSTEEGSPAGSPT STEEGTSTEPSEGSAPGTSESATPESGPGTSESATPESGPGTSESATPESGPGSEPAT SGSETPGSEPATSGSETPGSPAGSPTSTEEGTSTEPSEGSAPGTSTEPSEGSAPGGSA P | 656 |
| AE293 | PGSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSESATPEGAAEPE A | 657 |
| AE300 | PGSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSESATPESGPGSP AGAAEPEA | 658 |
| AE584 | PGSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSESATPESGPGSP AGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAPGTSTEPSEGSAP GSPAGSPTSTEEGTSTEPSEGSAPGTSESATPESGPGSEPATSGSETPGTSESATPES GPGSEPATSGSETPGTSESATPESGPGTSTEPSEGSAPGTSESATPESGPGSPAGSPT STEEGSPAGSPTSTEEGSPAGSPTSTEEGTSESATPESGPGTSTEPSEGSAPGAAEPE A | 659 |

In some embodiments, for constructing the sequence of a barcoded XTEN, amino-acid mutations are performed on XTEN of intermediate lengths to those of Table 3b, as well as XTEN of longer lengths than those of Table 3b, such as those in which one or more 12-mer motifs of Table 1 are added to the N- or C-terminus of a general-purpose XTEN of Table 3b.

Additional examples of general-purpose XTEN sequences that can be used according to the present disclosure are disclosed in U.S. Patent Publication Nos. 2010/0239554 A1, 2010/0323956 A1, 2011/0046060 A1, 2011/0046061 A1, 2011/0077199 A1, or 2011/0172146 A1, or International Patent Publication Nos. WO 2010091122 A1, WO 2010144502 A2, WO 2010144508 A1, WO 2011028228 A1, WO 2011028229 A1, WO 2011028344 A2, WO 2014/011819 A2, or WO 2015/023891.

In some embodiments, a barcoded XTEN fused within a polypeptide chain adjacent to the N-terminus of the polypeptide chain ("N-terminal XTEN") can be attached to a His tag of HFHHHHFH (SEQ ID NO: 48) or HHHHHHHH (SEQ ID NO: 49) at the N-terminus to facilitate the purification of the fusion polypeptide. In some embodiments, a barcoded XTEN fused within a polypeptide chain at the C-terminus of the polypeptide chain ("C-terminal XTEN") can be comprise or be attached to the sequence EPEA at the C-terminus to facilitate the purification of the fusion polypeptide. In some embodiment, the fusion polypeptide comprises both an N-terminal barcoded XTEN and a C-terminal barcoded XTEN, wherein the N-terminal barcoded XTEN is attached to a His tag of HHHHHHTFTH (SEQ ID NO: 48) or HHHHHHHH (SEQ ID NO: 49) at the N-terminus; and wherein the C-terminal barcoded XTEN is attached to the sequence EPEA at the C-terminus, thereby facilitating purification of the fusion polypeptide, for example, to at least 90%, 91%, 92%, 93%, 94%, 95%, 96%, 97%, 98%, or at least 99% purity by chromatography methods known in the art, including but not limited to IMAC chromatography, C-tagXL affinity matrix, and other such methods, including but not limited to those described in the EXAMPLES section below.

Protease Digestion

A barcode fragment, as described above or anywhere else herein, can be cleavably fused within the XTEN and releasable (configured to be released) from the XTEN upon digestion of the polypeptide by a protease. In some embodiments, the protease is a Glu-C protease. In some embodiments, the protease cleaves on the C-terminal side of glutamic acid residues that are not followed by proline. One of ordinary skill in the art will understand that a barcoded XTEN (an XTEN that contains barcode fragment(s) therewithin) is designed to achieve high efficiency, precision and accuracy of the protease digestion. For example, one of ordinary skill in the art will understand that adjacent Glu-Glu (EE) residues in an XTEN sequence can result in varying cleavage patterns upon Glu-C digestion. Accordingly, when Glu-C protease is used for barcode release, the barcoded XTEN or the barcode fragment(s) may not contain any Glu-Glu (EE) sequence. One of ordinary skill in the art will also understand that a di-peptide Glu-Pro (EP) sequence, if present in the fusion polypeptide, may not be cleaved by Glu-C protease during the barcode release process.

Structural Configuration of BPXTEN

In some embodiments, a BPXTEN fusion protein comprises a single BP and a single XTEN. Such BPXTEN can have at least the following permutations of configurations, each listed in an N- to C-terminus orientation: BP-XTEN; XTEN-BP; BP-S-XTEN; and XTEN-S-BP.

In some embodiments, the BPXTEN comprises a C-terminal XTEN and, optionally, a spacer sequence (S) (such as one described herein, e.g., in Table C) between the XTEN and the BP. Such BPXTEN can be represented by Formula I (depicted N- to C-terminus):

$$(BP)\text{-}(S)_x\text{-}(XTEN) \qquad (I),$$

wherein BP is a biologically active protein as described hereinbelow; S is a spacer sequence (such as one described herein, e.g., in Table C) having between 1 to about 50 amino acid residues that can optionally include a BP release segment (as described more fully hereinbelow); x is either 0 or 1; and XTEN can be any one as described hereinabove or anywhere else herein.

In some embodiments, the BPXTEN comprises an N-terminal XTEN and, optionally, a spacer sequence (S) (such as one described herein, e.g., in Table C) between the XTEN and the BP. Such BPXTEN can be represented by Formula II (depicted N- to C-terminus):

$$(XTEN)\text{-}(S)_x\text{-}(BP) \qquad (II),$$

wherein BP is a biologically active protein as described hereinbelow; S is a spacer sequence (such as one described herein, e.g., in Table C) having between 1 to about 50 amino acid residues that can optionally include a BP release segment (as described more fully hereinbelow); x is either 0 or 1; and XTEN can be any one as described hereinabove or anywhere else herein.

Figure 1:
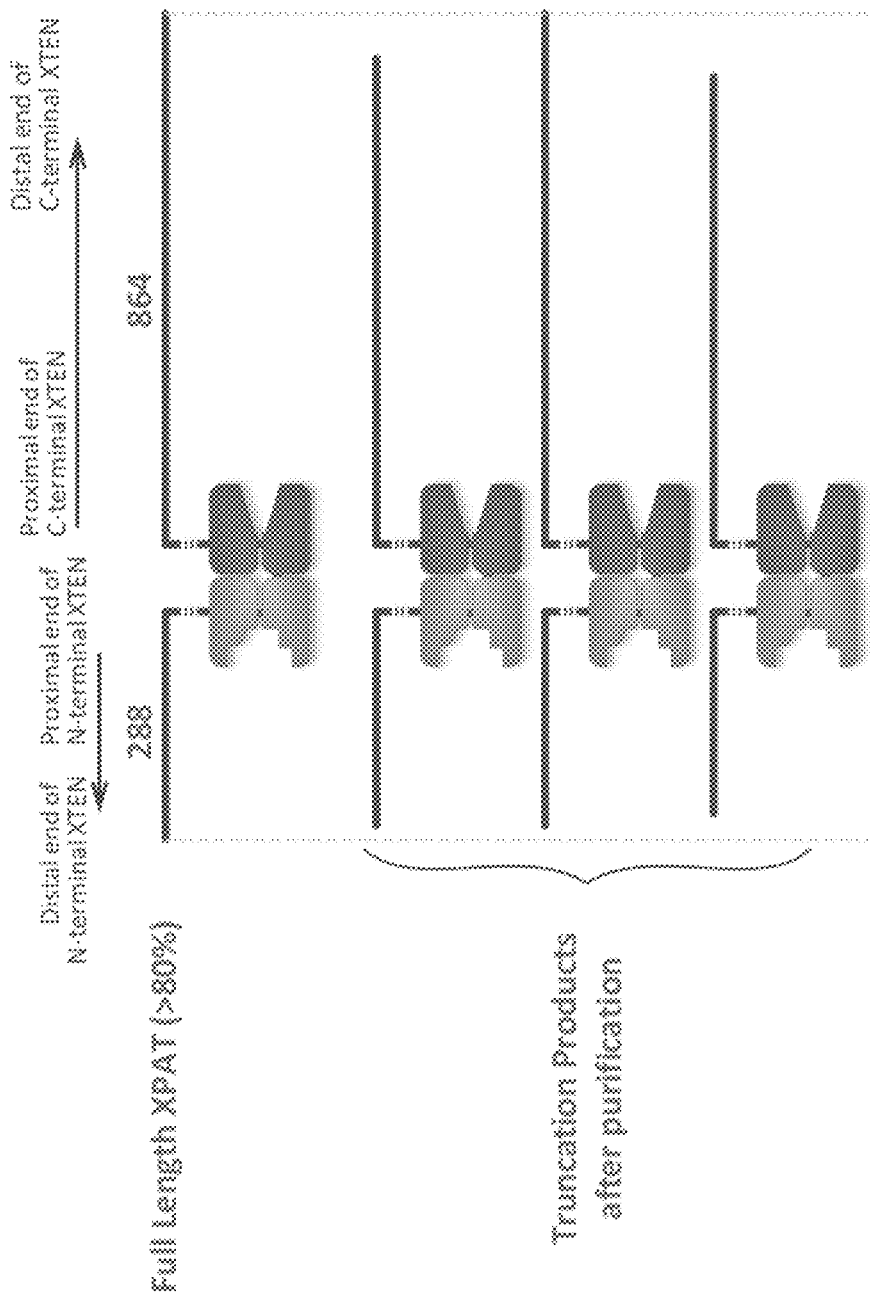
FIG. 1 depicts a mixture of XTENylated Protease-Activated T Cell Engager ("XPAT") polypeptides having varying lengths of XTEN. The full-length XPAT (top) comprises a 288 amino acid-long XTEN at the N-terminus and a 864 amino acid-long XTEN at the C-terminus. Various truncations can occur in the XPAT in one or both of the N- and C-terminal XTENs, for example, during fermentation, purification or other steps in product preparation. While products having limited truncations (truncations near a distal end an XTEN) may function in a manner similar to the full-length construct, severe truncations (truncations closer to the proximal end of the XTEN) may possess significantly different pharmacological properties from their full-length counterparts. The presence of truncations poses a challenge for quantifying the pharmacologically efficacious and inefficacious variants in an XPAT product.
Figure 2:
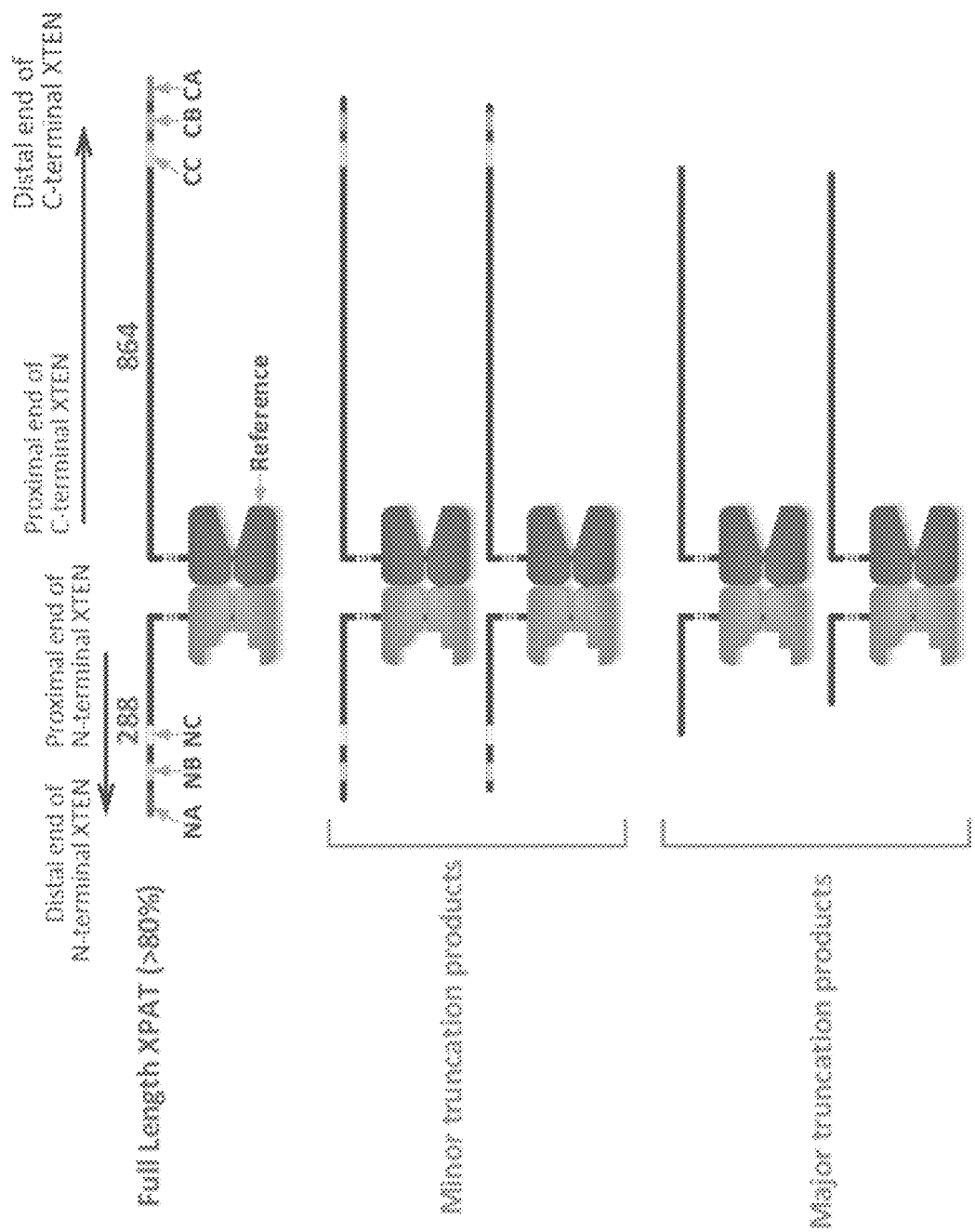
FIG. 2 depicts a mixture of XPAT polypeptides having varying lengths of barcoded XTEN. In the full-length XPAT (top), the 288 amino acid-long N-terminal XTEN contains three cleavably fused barcode sequences, "NA," "NB," and "NC" (from distal end to proximal end), and the 864 amino acid-long C-terminal XTEN contains three cleavably fused barcode sequences, "CC," "CB," and "CA" (from proximal end to distal end). Each barcode is positioned to indicate a pharmacologically-relevant length of the corresponding XTEN. For example, minor N-terminal truncation products of the XPAT, lacking the barcode "NA" (e.g., due to truncation) but having the more proximal barcodes "NB" and "NC," may show substantially the same pharmacological properties as the full-length construct. In contrast, major N-terminal truncation products of the XPAT, e.g., lacking all three barcodes (e.g., due to truncation) on the N-terminus, may discernibly differ in pharmacological activity from the full-length construct. A unique proteolytically-cleavable sequence is identified from the biologically-active polypeptide (here, the tandem scFvs that comprise the active portion of the T-cell engager) of the XPAT. Due to its presence in all the length variants of the XPAT (including full-length XPAT, minor truncations, and major truncations thereof), the unique proteolytically-cleavable sequence can be used as a reference for quantifying the amounts of various truncation products in relation to the total amount of the biologically active protein.
Figure 3:
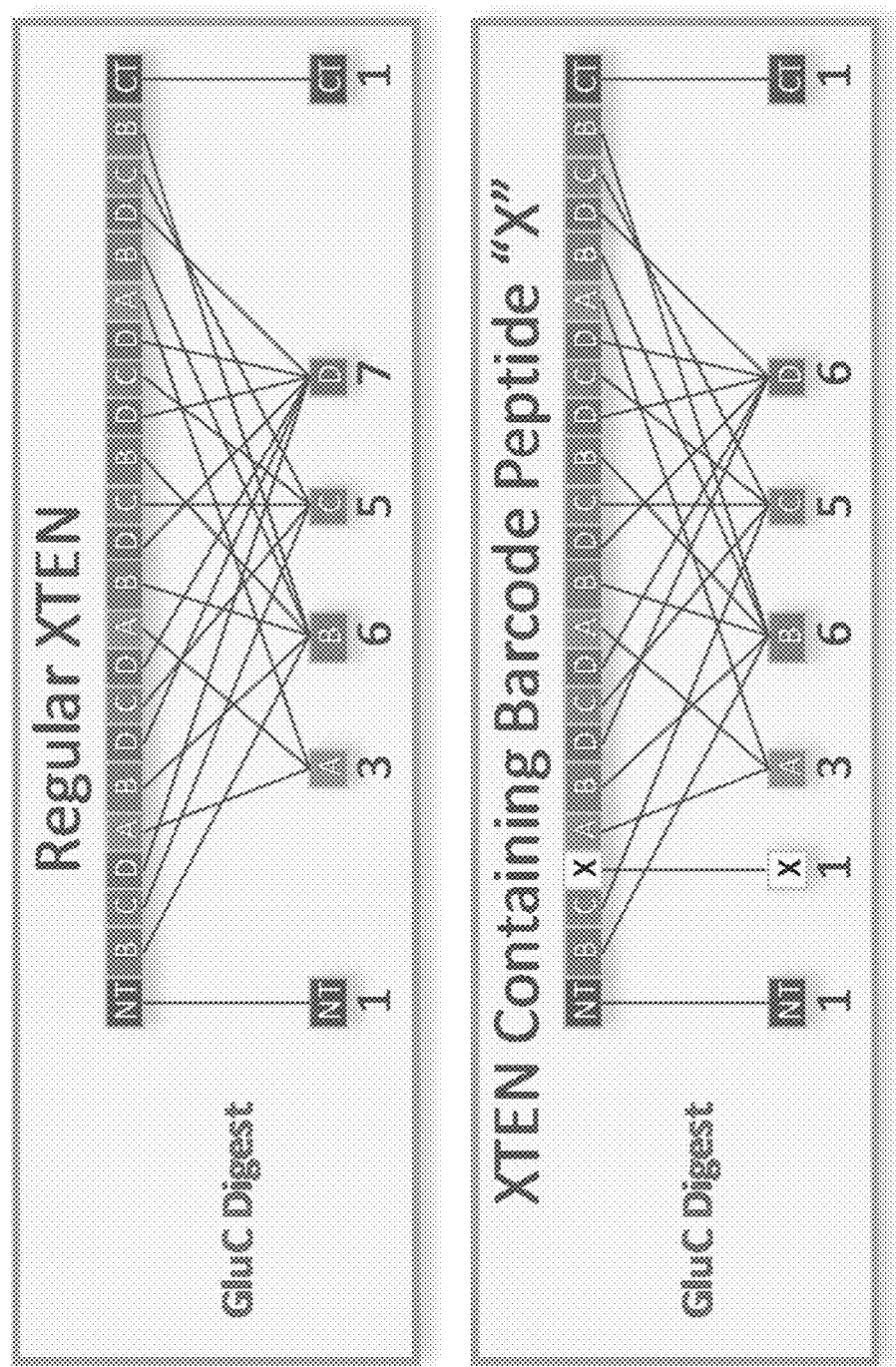
FIG. 3 illustrates a potential design for a barcoded XTEN by inserting a barcode-generating sequence into a general-purpose (or regular) XTEN. The exemplary general-purpose (or regular) XTEN (top) comprises non-overlapping 12-mer motifs in the sequence "BCDABDCDABDCBDCD-ABDCB," wherein the sequence motifs "A," "B," "C," and "D" occur 3, 6, 5, and 7 times, respectively. Glu-C protease digest of the exemplary general-purpose XTEN (upper panel) does not yield unique peptides except both termini ("NT" and "CT"). The insertion of a barcode-generating sequence, "X" (e.g., a unique 12-mer), into the XTEN results in a unique proteolytically-cleavable sequence (or barcode sequence) that does not occur anywhere else in the XTEN. The barcode-generating sequence, "X," can be positioned such that the resulting barcode marks a pharmacologically-relevant length of the XTEN. For example, an XTEN lacking a barcode due to truncation may functionally differ from the corresponding XTEN with the barcode. One of ordinary skill in the art will understand that the barcode-generating sequence ("X") can be the barcode sequence itself. Alternatively, the barcode-generating sequence ("X") can differ from the resulting barcode sequence. For example, the barcode sequence can overlap with and, thus, contain part of the preceding or following 12-mer motif.
Figure 4A:
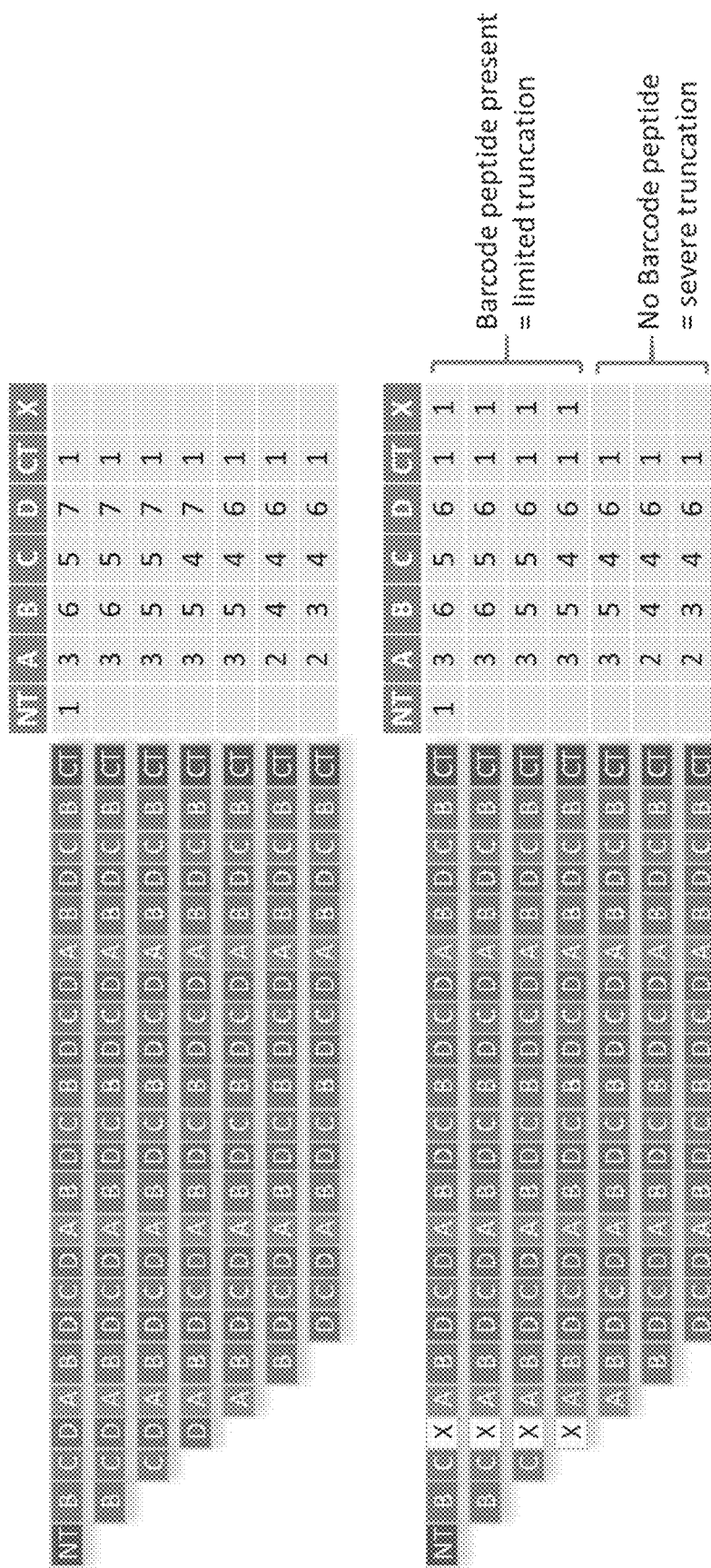
FIGS. 4A-4B illustrate the quantification of the level of truncation for an N-terminal XTEN.
Figure 4B:
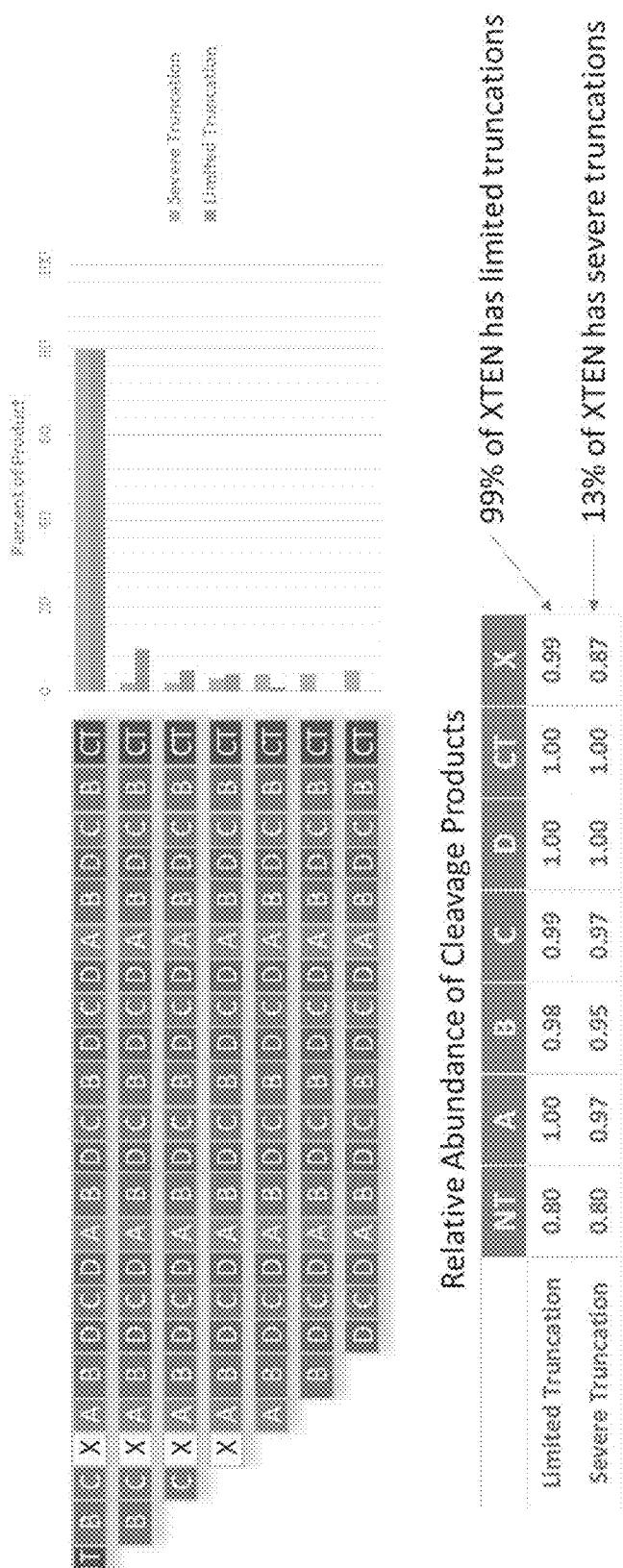

In some embodiment, the BPXTEN comprises both an N-terminal XTEN and a C-terminal XTEN. Such BPXTEN (e.g., the XPATs in FIGS. 1-2) can be represented by Formula III:

$$(XTEN)\text{-}(S)_y\text{-}(BP)\text{-}(S)_z\text{-}(XTEN) \qquad (III)$$

wherein BP is a biologically active protein as described hereinbelow; S is a spacer sequence (such as one described herein, e.g., in Table C) having between 1 to about 50 amino acid residues that can optionally include a BP release segment (as described more fully hereinbelow); y is either 0 or 1; z is either 0 or 1; and XTEN can be any one as described hereinabove or anywhere else herein.

Biologically Active Polypeptide

A biologically active protein (BP) fused to XTEN (as described herein above or described anywhere else herein), particularly those disclosed hereinbelow, comprising sequences identified herein by those of Tables 6a-6f, together with their corresponding nucleic acid and amino acid sequences, are well known in the art. Descriptions and sequences of these BP are available in public databases such as Chemical Abstracts Services Databases (e.g., the CAS Registry), GenBank, The Universal Protein Resource (UniProt) and subscription provided databases such as GenSeq (e.g., Derwent). Polynucleotide sequences may be a wild type polynucleotide sequence encoding a given BP (e.g., either full length or mature), or in some instances the sequence may be a variant of the wild type polynucleotide sequence (e.g., a polynucleotide which encodes the wild type biologically active protein), wherein the DNA sequence of the polynucleotide has been optimized, for example, for expression in a particular species; or a polynucleotide encoding a variant of the wild type protein, such as a site directed mutant or an allelic variant. It is well within the ability of the skilled artisan to use a wild-type or consensus cDNA sequence or a codon-optimized variant of a BP to create BPXTEN constructs contemplated by the invention using methods known in the art and/or in conjunction with the guidance and methods provided herein.

The BP for inclusion in the BPXTEN (a fusion polypeptide comprising at least one BP and at least one XTEN) can include any protein of biologic, therapeutic, prophylactic, or diagnostic interest or function, or that is useful for mediating a biological activity or preventing or ameliorating a disease, disorder or conditions when administered to a subject. Of particular interest are BP for which an increase in a pharmacokinetic parameter, increased solubility, increased stability, masking of activity, or some other enhanced pharmaceutical property is sought, or those BP for which increasing the terminal half-life would improve efficacy, safety, or result in reduce dosing frequency and/or improve patient compliance. Thus, the BPXTEN fusion protein compositions are prepared with various objectives in mind, including improving the therapeutic efficacy of the bioactive compound by, for example, increasing the in vivo exposure or the length that the BPXTEN remains within the therapeutic window when administered to a subject, compared to a BP not linked to XTEN.

A BP can be a native, full-length protein or can be a fragment or a sequence variant of a biologically active protein that retains at least a portion of the biological activity of the native protein.

In one embodiment, the BP incorporated into the subject compositions can be a recombinant polypeptide with a sequence corresponding to a protein found in nature. In some embodiments, the BP can be sequence variants, fragments, homologs, and mimetics of a natural sequence that retain at least a portion of the biological activity of the native BP. In non-limiting examples, a BP can be a sequence that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a protein sequence identified herein. In further non-limiting examples, a BP can be a bispecific sequence comprising a first binding domain and a second binding domain, wherein the first binding domain, having specific binding affinity to a tumor-specific marker or an antigen of a target cell, exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to paired VL and VH sequences of an anti-CD3 antibody identified herein by Table 6f; and wherein the second binding domain, having specific binding affinity to an effector cell, exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to paired VL and VH sequences of an anti-target cell antibody identified herein by Table 6a. In one embodiment, a BPXTEN fusion protein can comprise a single BP molecule linked to an XTEN. In some embodiments, the BPXTEN can comprise a first BP and a second molecule of the same BP, resulting in a fusion protein comprising the two BP linked to one or more XTEN (for example, two molecules of glucagon, or two molecules of hGH).

In general, BP will exhibit a binding specificity to a given target (or a given number of targets) or another desired biological characteristic when used in vivo or when utilized in an in vitro assay. For example, the BP can be an agonist, a receptor, a ligand, an antagonist, an enzyme, an antibody (e.g., mono- or bi-specific), or a hormone. Of particular interest are BP used or known to be useful for a disease or disorder wherein the native BP have a relatively short terminal half-life and for which an enhancement of a pharmacokinetic parameter (which optionally could be released from the fusion protein by cleavage of a spacer sequence) would permit less frequent dosing or an enhanced pharmacologic effect. Also of interest are BP that have a narrow therapeutic window between the minimum effective dose or blood concentration (Cmin) and the maximum tolerated dose or blood concentration (Cmax). In such cases, the linking of the BP to a fusion protein comprising a select XTEN sequence(s) can result in an improvement in these properties, making them more useful as therapeutic or preventive agents compared to BP not linked to XTEN.

The BP encompassed by the inventive compositions can have utility in the treatment in various therapeutic or disease categories, including but not limited to glucose and insulin disorders, metabolic disorders, cardiovascular diseases, coagulation and bleeding disorders, growth disorders or conditions, endocrine disorders, eye diseases, kidney diseases, liver diseases, tumorigenic conditions, inflammatory conditions, autoimmune conditions, etc.

"Anti-CD3" means the monoclonal antibody against the T cell surface protein CD3, species and sequence variants, and fragments thereof, including OKT3 (also called muromonab) and humanized anti-CD3 monoclonal antibody (hOKT31(Ala-Ala))(K C Herold et al., New England Journal of Medicine 346:1692-1698. 2002) Anti-CD3 prevents T-cell activation and proliferation by binding the T-cell receptor complex present on all differentiated T cells. Anti-CD3-containing fusion proteins of the invention may find particular use to slow new-onset Type 1 diabetes, including use of the anti-CD3 as a therapeutic effector as well as a targeting moiety for a second therapeutic BP in the BPXTEN composition. The sequences for the variable region and the creation of anti-CD3 have been described in U.S. Pat. Nos. 5,885,573 and 6,491,916.

The BP of the subject compositions are not limited to native, full-length polypeptides, but also include recombinant versions as well as biologically and/or pharmacologically active variants or fragments thereof. For example, it will be appreciated that various amino acid substitutions can be made in the GP to create variants without departing from the spirit of the invention with respect to the biological activity or pharmacologic properties of the BP. Examples of conservative substitutions for amino acids in polypeptide sequences are shown in Table 5. However, in embodiments of the BPXTEN in which the sequence identity of the BP is less than 100% compared to a specific sequence disclosed herein, the invention contemplates substitution of any of the other 19 natural L-amino acids for a given amino acid residue of the given BP, which may be at any position within the sequence of the BP, including adjacent amino acid residues. If any one substitution results in an undesirable change in biological activity, then one of the alternative amino acids can be employed and the construct evaluated by the methods described herein, or using any of the techniques and guidelines for conservative and non-conservative mutations set forth, for instance, in U.S. Pat. No. 5,364,934, the contents of which is incorporated by reference in its entirety, or using methods generally known to those of skill in the art. In addition, variants can also include, for instance, polypeptides wherein one or more amino acid residues are added or deleted at the N- or C-terminus of the full-length native amino acid sequence of a BP that retains at least a portion of the biological activity of the native peptide.

TABLE 5

Exemplary conservative amino acid substitutions

| Original Residue | Exemplary Substitutions |
| --- | --- |
| Ala (A) | val; leu; ile |
| Arg (R) | lys; gin; asn |
| Asn (N) | gin; his; lys; arg |
| Asp (D) | glu |
| Cys (C) | ser |
| Gln (Q) | asn |
| Glu (E) | asp |
| Gly (G) | pro |
| His (H) | asn: gin: Iys: arg |
| xIle (I) | leu; val; met; ala; phe: norleucine |
| Leu (L) | norleucine: ile: val; met; ala: phe |
| Lys (K) | arg: gin: asn |
| Met (M) | leu; phe; ile |
| Phe (F) | leu: val: ile; ala |
| Pro (P) | gly |
| Ser (S) | thr |
| Thr (T) | ser |
| Trp (W) | tyr |
| Tyr(Y) | trp: phe: thr: ser |
| Val (V) | ile; leu; met; phe; ala; norleucine |

In some embodiments, a BP incorporated into a BPXTEN fusion protein can have a sequence that exhibits at least about 80% sequence identity to a sequence, alternatively at least about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99%, or 100% sequence identity. In some embodiments, a BP incorporated into a BPXTEN can be a bispecific sequence comprising a first binding domain and a second binding domain, wherein the first binding domain, having specific binding affinity to a tumor-specific marker or an antigen of a target cell, exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to paired VL and VH sequences of an anti-CD3 antibody identified herein by Table 6f; and wherein the second binding domain, having specific binding affinity to an effector cell, exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to paired VL and VH sequences of an anti-target cell antibody identified herein by Table 6a. The BP of the foregoing embodiments can be evaluated for activity using assays or measured or determined parameters as described herein, and those sequences that retain at least about 40%, or about 50%, or about 55%, or about 60%, or about 70%, or about 80%, or about 90%, or about 95% or more activity compared to the corresponding native BP sequence would be considered suitable for inclusion in the subject BPXTEN. The BP found to retain a suitable level of activity can be linked to one or more XTEN polypeptides described hereinabove or anywhere else herein. In one embodiment, a BP found to retain a suitable level of activity can be linked to one or more XTEN polypeptides, having at least about 80% sequence identity (e.g., at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or 100% sequence identity) to a sequence from Tables 3a-3b, resulting in a chimeric fusion protein.

T Cell Engagers

Additional structural configuration formulae of BPXTEN relate to XTENylated Protease-Activated T Cell Engagers ("XPAT" or "XPATs"), wherein BP is a bispecific antibody (e.g., a bispecific T-cell engager). In some embodiments, the XPAT composition comprises (1) a first portion comprising a first binding domain and a second binding domain, and (2) a second portion comprising the release segment, and (3) a third portion comprising the bulking moiety. In some embodiments, the XPAT composition has the configuration of Formula Ia (depicted N-terminus to C-terminus):

(first portion)-(second portion)-(third portion)　　(Ia)

wherein first portion is a bispecific comprising two scFv wherein the first binding domain has specific binding affinity to a tumor-specific marker or an antigen of a target cell and the second binding domain has specific binding affinity to an effector cell; the second portion comprises a release segment (RS) capable of being cleaved by a mammalian protease (as described more fully hereinbelow, the protease can be tumor- or antigen-specific, thereby activation); and the third portion is a bulking moiety. In the foregoing embodiment, the first portion binding domains can be in the order (VL-VH)1-(VL-VH)2, wherein "1" and "2" represent the first and second binding domains, respectively, or (VL-VH)1-(VH-VL)2, or (VH-VL)1-(VL-VH)2, or (VH-VL)1-(VH-VL)2, wherein the paired binding domains are linked by a polypeptide linker (as described more fully hereinbelow). In one embodiment, the first portion VL and VH are set forth in Tables 6a-6f; RS is identified herein by the group of sequences set forth in Tables 8a-8b (as described more fully hereinbelow); and the bulking moiety is XTEN; albumin binding domain; albumin; IgG binding domain; polypeptides consisting of proline, serine, and alanine; fatty acid; Fc domain; polyethylene glycol (PEG), PLGA; or hydroxylethyl starch. Where desired, the bulking moiety is an XTEN having at least about 90%, 91%, 92%, 93%, 94%, 95%, 96%, 97%, 98%, 99%, or 100% sequence identity to a sequence comprising the group of sequences set forth in Tables 3a-3b. In the foregoing embodiments, the composition is a recombinant fusion protein. In some embodiments, the portions are linked by chemical conjugation.

In some embodiments, the XPAT composition has the configuration of Formula IIa (depicted N-terminus to C-terminus):

(third portion)-(second portion)-(first portion)　　(IIa)

wherein first portion is a bispecific comprising two scFv wherein the first binding domain has specific binding affinity to a tumor-specific marker or an antigen of a target cell and the second binding domain has specific binding affinity to an effector cell; the second portion comprises a release segment (RS) capable of being cleaved by a mammalian protease; and the third portion is a bulking moiety. In the foregoing embodiment, the first portion binding domains can be in the order (VL-VH)1-(VL-VH)2, wherein "1" and "2" represent the first and second binding domains, respectively, or (VL-VH)1-(VH-VL)2, or (VH-VL)1-(VL-VH)2, or (VH-VL)1-(VH-VL)2, wherein the paired binding domains are linked by a polypeptide linker as described herein, below. In one embodiment, the first portion VL and VH are identified in Tables 6a-6f; RS is identified herein as the group of sequences set forth in Tables 8a-8b; and the bulking moiety is XTEN; albumin binding domain; albumin; IgG binding domain; polypeptides consisting of proline, serine, and alanine; fatty acid; or Fc domain. Where desired, the bulking moiety is an XTEN having at least about 90%, 91%, 92%, 93%, 94%, 95%, 96%, 97%, 98%, 99%, or 100% sequence identity to a sequence comprising the group of sequences set forth in Tables 3a-3b. In the foregoing embodiments, the composition is a recombinant fusion protein. In some embodiments, the portions are linked by chemical conjugation.

In some embodiments, the XPAT composition has the configuration of Formula IIIa (depicted N-terminus to C-terminus):

(fifth portion)-(fourth portion)-(first portion)-(second portion)-(third portion)　　(IIIa)

wherein first portion is a bispecific comprising two scFv wherein the first binding domain has specific binding affinity to a tumor-specific marker or an antigen of a target cell and the second binding domain has specific binding affinity to an effector cell; the second portion comprises a release segment (RS) capable of being cleaved by a mammalian protease; the third portion is a bulking moiety; the fourth portion comprises a release segment (RS) capable of being cleaved by a mammalian protease which may be identical or different from the second portion; and the fifth portion is a bulking moiety that may be identical or may be different from the third portion. In the foregoing embodiment, the first portion binding domains can be in the order (VL-VH)1-(VL-VH)2, wherein "1" and "2" represent the first and second binding domains, respectively, or (VL-VH)1-(VH-VL)2, or (VH-VL)1-(VL-VH)2, or (VH-VL)1-(VH-VL)2, wherein the paired binding domains are linked by a polypeptide linker as described herein, below. In the foregoing embodiments, the RS is identified as sequences set forth in Tables 8a-8b. In the foregoing embodiments, the bulking moiety is XTEN; albumin binding domain; albumin; IgG binding domain; polypeptides consisting of proline, serine, and alanine; fatty acid; or Fc domain. Where desired, the bulking moiety is an XTEN having at least about 90%, 91%, 92%, 93%, 94%, 95%, 96%, 97%, 98%, 99%, or 100% sequence identity to a sequence identified herein by the sequences set forth in Tables 3a-3b. In the foregoing embodiments, the composition is a recombinant fusion protein. In some embodiments, the portions are linked by chemical conjugation.

The subject compositions, based on their design and specific components, advantageously provide bispecific therapeutics that have more selectivity, greater half-life, and result in less toxicity and fewer side effects once they are cleaved by proteases found in associated with the target tissues or tissues rendered unhealthy by a disease, such that the subject compositions have improved therapeutic index compared to bispecific antibody compositions known in the art. Such compositions are useful in the treatment of certain diseases, including, but not limited to cancer. It will be appreciated by those of skill in the art that the compositions of the instant invention achieve this reduction in non-specific interactions by a combination of mechanism, which include steric hindrance by locating the binding domains to the bulky XTEN molecules, steric hindrance in that the flexible, unstructured characteristic of the long flexible XTEN polypeptides, by being tethered to the composition, are able to oscillate and move around the binding domains, providing blocking between the composition and tissues or cells, as well as a reduction in the ability of the intact composition to penetrate a cell or tissue due to the large molecular mass (contributed to by both the actual molecular weight of the XTEN and due to the large hydrodynamic radius of the unstructured XTEN) compared to the size of the individual binding domains. However, the compositions are designed such that when in proximity to a target tissue or cell bearing or secreting a protease capable of cleaving the RS, or when internalized into a target cell or tissue when a binding domain has bound the ligand, the bispecific binding domains are liberated from the bulk of the XTEN by the action of the protease(s), removing the steric hindrance barrier, and is freer to exert its pharmacologic effect. The subject compositions find use in the treatment of a variety of conditions where selective delivery of a therapeutic bispecific antibody composition to a cell, tissue or organ is desired. In one embodiment, the target tissue is a cancer, which may be a leukemia, a lymphoma, or a tumor of an organ or system.

Binding Domains

The disclosure contemplates use of single chain binding domains, such as but not limited to Fv, Fab, Fab', Fab'-SH, F(ab')2, linear antibodies, single domain antibody, single domain camelid antibody, single-chain antibody molecules (scFv), and diabodies capable of binding ligands or receptors associated with effector cells and antigens of diseased tissues or cells that are cancers, tumors, or other malignant tissues. In some embodiments, an antigen binding fragment (AF) (e.g., a first antigen binding fragment (AF1), or a second antigen binding fragment (AF2)) can (each independently) be a chimeric or a humanized antigen binding fragment. The antigen binding fragment (AF) (e.g., a first antigen binding fragment (AF1), or a second antigen binding fragment (AF2)) can (each independently) be Fv, Fab, Fab', Fab'-SH, linear antibody, or single-chain variable fragment (scFv). Two antigen binding fragments (e.g., the first and second antigen binding fragments) can be configured as an (Fab')2 or a single chain diabody. In some embodiments, the bispecific comprises a first binding domain with binding specificity to a target cell marker and a second binding domain with binding specificity to an effector cell antigen. In some embodiments, the first and the second binding domains can be non-antibody scaffolds such as anticalins, adnectins, fynomers, affilins, affibodies, centyrins, or DARPins. In other embodiments, the binding domain for the tumor cell target is a variable domain of a T cell receptor that has been engineered to bind MHC that is loaded with a peptide fragment of a protein that is overexpressed by tumor cells. In some embodiments, the XPAT compositions are designed with considerations of the location of the target tissue protease as well as the presence of the same protease in healthy tissues not intended to be targeted, as well as the presence of the target ligand in healthy tissue but a greater presence of the ligand in unhealthy target tissue, in order to provide a wide therapeutic window. A "therapeutic window" refers to the largest difference between the minimal effective dose and the maximal tolerated dose for a given therapeutic composition. To help achieve a wide therapeutic window, the binding domains of the first portion of the compositions are shielded by the proximity of the bulking moiety (e.g., XTEN) such that the binding affinity of the intact composition for one or both of the ligands is reduced compared to the composition that has been cleaved by a mammalian protease, thereby releasing the first portion from the shielding effects of the bulking moiety.

With respect to single chain binding domains, as is well established, Fv is the minimum antibody fragment which contains a complete antigen recognition and binding site; consisting of a dimer of one heavy (VH) and one light chain variable domain (VL) in non-covalent association. Within each VH and VL chain are three complementarity determining regions (CDRs) that interact to define an antigen binding site on the surface of the VH-VL dimer; the six CDRs of a binding domain confer antigen binding specificity to the antibody or single chain binding domain. In some cases, scFv are created in which each has 3, 4, or 5 CHRs within each binding domain. Framework sequences flanking the CDRs have a tertiary structure that is essentially conserved in native immunoglobulins across species, and the framework residues (FR) serve to hold the CDRs in their appropriate orientation. The constant domains are not required for binding function, but may aid in stabilizing VH-VL interaction. In some embodiments, the domain of the binding site of the polypeptide can be a pair of VH-VL, VH-VH or VL-VL domains either of the same or of different immunoglobulins, however it is generally preferred to make single chain binding domains using the respective VH and VL chains from the parental antibody. The order of VH and VL domains within the polypeptide chain is not limiting for the present invention; the order of domains given may be reversed usually without any loss of function, but it is understood that the VH and VL domains are arranged so that the antigen binding site can properly fold. Thus, the single chain binding domains of the bispecific scFv embodiments of the subject compositions can be in the order (VL-VH)1-(VL-VH)2, wherein "1" and "2" represent the first and second binding domains, respectively, or (VL-VH)1-(VH-VL)2, or (VH-VL)1-(VL-VH)2, or (VH-VL)1-(VH-VL)2, wherein the paired binding domains are linked by a polypeptide linker as described herein, below.

The arrangement of the binding domains in an exemplary bispecific single chain antibody disclosed herein may therefore be one in which the first binding domain is located C-terminally to the second binding domain. The arrangement of the V chains may be VH (target cell surface antigen)-VL(target cell surface antigen)-VL(effector cell antigen)-VH(effector cell antigen), VH(target cell surface antigen)-VL(target cell surface antigen)-VH(effector cell antigen)-VL(effector cell antigen), VL(target cell surface antigen)-VH(target cell surface antigen)-VL(effector cell antigen)-VH(effector cell antigen) or VL(target cell surface antigen)-VH(target cell surface antigen)-VH(effector cell antigen)-VL(effector cell antigen). For an arrangement, in which the second binding domain is located N-terminally to the first binding domain, the following orders are possible: VH (effector cell antigen)-VL(effector cell antigen)-VL(target cell surface antigen)-VH(target cell surface antigen), VH(effector cell antigen)-VL(effector cell antigen)-VH(target cell surface antigen)-VL(target cell surface antigen), VL(effector cell antigen)-VH(effector cell antigen)-VL(target cell surface antigen)-VH(target cell surface antigen) or VL(effector cell antigen)-VH(effector cell antigen)-VH(target cell surface antigen)-VL(target cell surface antigen). As used herein, "N-terminally to" or "C-terminally to" and grammatical variants thereof denote relative location within the primary amino acid sequence rather than placement at the absolute N- or C-terminus of the bispecific single chain antibody. Hence, as a non-limiting example, a first binding domain which is "located C-terminally to the second binding domain" denotes that the first binding is located on the carboxyl side of the second binding domain within the bispecific single chain antibody, and does not exclude the possibility that an additional sequence, for example a His-tag, or another compound such as a radioisotope, is located at the C-terminus of the bispecific single chain antibody.

In one embodiment, the chimeric polypeptide assembly compositions comprise a first portion comprising a first binding domain and a second binding domain wherein each of the binding domains is an scFv and wherein each scFv comprises one VL and one VH. In some embodiments, the chimeric polypeptide assembly compositions comprise a first portion comprising a first binding domain and a second binding domain wherein the binding domains are in a diabody configuration and wherein each domain comprises one VL domain and one VH.

It is envisaged that the scFv embodiments of the XPAT compositions of the invention comprise a first binding domain and a second binding domain wherein the VL and VH domains are derived from monoclonal antibodies with binding specificity to the tumor-specific marker or an antigen of a target cell and effector cell antigens, respectively. In other cases, the first and second binding domains each comprise six CDRs derived from monoclonal antibodies with binding specificity to a target cell marker, such as a tumor-specific marker and effector cell antigens, respectively. In other embodiments, the first and second binding domains of the first portion of the subject compositions can have 3, 4, or 5 CHRs within each binding domain. In other embodiments, the embodiments of the invention comprise a first binding domain and a second binding domain wherein each comprises a CDR-H1 region, a CDR-H2 region, a CDR-H3 region, a CDR-L1 region, a CDR-L2 region, and a CDR-H3 region, wherein each of the regions is derived from a monoclonal antibody capable of binding the tumor-specific marker or an antigen of a target cell, and effector cell antigens, respectively. In one embodiment, the invention provides a chimeric polypeptide assembly composition wherein the second binding domain comprises VH and VL regions derived from a monoclonal antibody capable of binding human CD3. In some embodiments, the invention provides a chimeric polypeptide assembly composition, wherein the scFv second binding domain comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of an anti-CD3 antibody identified in Table 6a. In some embodiments, the second domain embodiments of the invention comprise a CDR-H1 region, a CDR-H2 region, a CDR-H3 region, a CDR-L1 region, a CDR-L2 region, and a CDR-H3 region, wherein each of the regions is derived from a monoclonal antibody identified herein as the antibodies set forth in Table 6a. In the foregoing embodiments, the VH and/or VL domains can be configured as scFv, diabodies, a single domain antibody, or a single domain camelid antibody.

In other embodiments, the second domains of the subject compositions are derived from an anti-CD3 antibody identified herein as the antibodies set forth in Table 6a. In one embodiment of the foregoing, the second domain of the subject composition comprises the paired VL and the VH region sequences of the anti-CD3 antibody identified herein as the group of antibodies set forth in Table 6a. In some embodiments, the invention provides a chimeric polypeptide assembly composition, wherein the second binding domain comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of the huUCHT1 anti-CD3 antibody of Table 6a. In the foregoing embodiments, the VH and/or VL domains can be configured as scFv, a portion of a diabody, a single domain antibody, or a single domain camelid antibody.

In other embodiments, the scFv of the first domain of the composition are derived from an anti-tumor cell antibody identified as the antibodies set forth in Table 6f. In some embodiments, the invention provides a chimeric polypeptide assembly composition, wherein the first binding domain comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of an anti-tumor cell antibody identified in Table 6f. In one embodiment of the foregoing, the first domain of the recited compositions comprises the paired VL and the VH region sequences of an anti-tumor cell antibody disclosed herein. In the foregoing embodiments, the VH and/or VL domains can be configured as scFv, a portion of a diabody, a single domain antibody, or a single domain camelid antibody.

In some embodiments, the chimeric polypeptide assembly compositions comprise a first portion comprising a first binding domain and a second binding domain wherein the binding domains are in a diabody configuration and each of the binding domains comprises one VL domain and one VH domain. In one embodiment, the diabody embodiments of the invention comprise a first binding domain and a second binding domain wherein the VL and VH domains are derived from monoclonal antibodies with binding specificity to a tumor-specific marker or an antigen of a target cell, and the effector cell antigen, respectively. In some embodiments, the diabody embodiments of the invention comprise a first binding domain and a second binding domain wherein each comprises a CDR-H1 region, a CDR-H2 region, a CDR-H3 region, a CDR-L1 region, a CDR-L2 region, and a CDR-H3 region, wherein each of the regions is derived from a monoclonal antibody capable of binding the tumor-specific marker or target cell antigen, and the effector cell antigen, respectively. It is envisaged that the diabody embodiments of the invention comprise a first binding domain and a second binding domain wherein the VL and VH domains are derived from monoclonal antibodies with binding specificity to the tumor-specific marker or target cell antigen, and the effector cell antigen, respectively. In some embodiments, the diabody embodiments of the invention comprise a first binding domain and a second binding domain wherein each comprises a CDR-H1 region, a CDR-H2 region, a CDR-H3 region, a CDR-L1 region, a CDR-L2 region, and a CDR-H3 region, wherein each of the regions is derived from a monoclonal antibody capable of binding the tumor-specific marker or target cell antigen, and the effector cell antigen, respectively. In one embodiment, the invention provides a chimeric polypeptide assembly composition wherein the diabody second binding domain comprises the paired VH and VL regions derived from a monoclonal antibody capable of binding human CD3. In some embodiments, the invention provides a chimeric polypeptide assembly composition, wherein the diabody second binding domain comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of an anti-CD3 antibody identified in Table 6a. In some embodiments, the invention provides a chimeric polypeptide assembly composition, wherein the diabody second binding domain comprises VH and VL regions wherein each VH and VL regions exhibit at least about 90%, or 91%, or 92%, or 93%, or 94%, or 95%, or 96%, or 97%, or 98%, or 99% identity to or is identical to the VL and a VH sequence of the huUCHT1 antibody of Table 6a. In other embodiments, the diabody second domain of the composition is derived from an anti-CD3 antibody described herein. In some embodiments, the invention provides a chimeric polypeptide assembly composition, wherein the diabody first binding domain comprises VH and VL regions wherein each VH and VL regions exhibit at least about 90%, or 91%, or 92%, or 93%, or 94%, or 95%, or 96%, or 97%, or 98%, or 99% identity to or is identical to VL and VH sequences of an anti-tumor cell antibody identified in Table 6f. In other embodiments, the diabody first domain of the composition is derived from an anti-tumor cell antibody described herein.

Methods to measure binding affinity and/or other biologic activity of the subject compositions of the invention can be those disclosed herein or methods generally known in the art. For example, the binding affinity of a binding pair (e.g., antibody and antigen), denoted as $K_d$, can be determined using various suitable assays including, but not limited to, radioactive binding assays, non-radioactive binding assays such as fluorescence resonance energy transfer and surface plasmon resonance (SPR, Biacore), and enzyme-linked immunosorbent assays (ELISA), kinetic exclusion assay (KinExA®) or as described in the Examples. An increase or decrease in binding affinity, for example of a chimeric polypeptide assembly which has been cleaved to remove a bulking moiety compared to the chimeric polypeptide assembly with the bulking moiety attached, can be determined by measuring the binding affinity of the chimeric polypeptide assembly to its target binding partner with and without the bulking moiety.

Measurement of half-life of a subject chimeric assembly can be performed by various suitable methods. For example, the half-life of a substance can be determined by administering the substance to a subject and periodically sampling a biological sample (e.g., biological fluid such as blood or plasma or ascites) to determine the concentration and/or amount of that substance in the sample over time. The concentration of a substance in a biological sample can be determined using various suitable methods, including enzyme-linked immunosorbent assays (ELISA), immunoblots, and chromatography techniques including high-pressure liquid chromatography and fast protein liquid chromatography. In some cases, the substance may be labeled with a detectable tag, such as a radioactive tag or a fluorescence tag, which can be used to determine the concentration of the substance in the sample (e.g., a blood sample or a plasma sample. The various pharmacokinetic parameters are then determined from the results, which can be done using software packages such as SoftMax Pro software, or by manual calculations known in the art.

In addition, the physicochemical properties of the chimeric polypeptide assembly compositions may be measured to ascertain the degree of solubility, structure and retention of stability. Assays of the subject compositions are conducted that allow determination of binding characteristics of the binding domains towards a ligand, including binding dissociation constant ($K_d$, $K_{on}$ and $K_{off}$), the half-life of dissociation of the ligand-receptor complex, as well as the activity of the binding domain to inhibit the biologic activity of the sequestered ligand compared to free ligand ($IC_{50}$ values). The term "$IC_{50}$" refers to the concentration needed to inhibit half of the maximum biological response of the ligand agonist, and is generally determined by competition binding assays. The term "$EC_{50}$" refers to the concentration needed to achieve half of the maximum biological response of the active substance, and is generally determined by ELISA or cell-based assays, including the methods of the Examples described herein.

Anti-CD3 Binding Domains

In some embodiments, the invention provides chimeric polypeptide assembly compositions comprising a binding domain of the first portion with binding affinity to T cells. In one embodiment, the binding domain of the second portion comprises VL and VH derived from a monoclonal antibody that binds CD3. In some embodiments, the binding domain comprises VL and VH derived from a monoclonal antibody to CD3 epsilon and/or CD3 delta. Exemplary, non-limiting examples of VL and VH sequences of monoclonal antibodies to CD3 are presented in Table 6a. In one embodiment, the invention provides a chimeric polypeptide assembly comprising a binding domain with binding affinity to CD3 comprising anti-CD3 VL and VH sequences set forth in Table 6a. In some embodiments, the invention provides a chimeric polypeptide assembly comprising a binding domain of the first portion with binding affinity to CD3epsilon comprising anti-CD3epsilon VL and VH sequences set forth in Table 6a. In some embodiments, the invention provides a chimeric polypeptide assembly composition, wherein the scFv second binding domain of the first portion comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of the huUCHT1 anti-CD3 antibody of Table 6a. In some embodiments, the invention provides a chimeric polypeptide assembly composition comprising a binding domain with binding affinity to CD3 comprising the CDR-L1 region, the CDR-L2 region, the CDR-L3 region, the CDR-H1 region, the CDR-H2 region, and the CDR-H3 region, wherein each is derived from the respective anti-CD3 VL and VH sequences set forth in Table 6a. In some embodiments, the invention provides a chimeric polypeptide assembly composition comprising a binding domain with binding affinity to CD3 comprising the CDR-L1 region, the CDR-L2 region, the CDR-L3 region, the CDR-H1 region, the CDR-H2 region, and the CDR-H3 region, wherein the CDR sequences are RASQDIRNYLN (SEQ ID NO: 50), YTSRLESQQGNTLPWT (SEQ ID NO: 78), GYSFTGYTMN (SEQ ID NO: 79), LINPYKGVST (SEQ ID NO: 80), and SGYYGDSDWYFDV (SEQ ID NO: 81).

The CD3 complex is a group of cell surface molecules that associates with the T-cell antigen receptor (TCR) and functions in the cell surface expression of TCR and in the signaling transduction cascade that originates when a peptide:MHC ligand binds to the TCR. Typically, when an antigen binds to the T-cell receptor, the CD3 sends signals through the cell membrane to the cytoplasm inside the T cell. This causes activation of the T cell that rapidly divide to produce new T cells sensitized to attack the particular antigen to which the TCR were exposed. The CD3 complex is comprised of the CD3epsilon molecule, along with four other membrane-bound polypeptides (CD3-gamma, -delta, and/or -zeta). In humans, CD3-epsilon is encoded by the CD3E gene on Chromosome 11. The intracellular domains of each of the CD3 chains contain immunoreceptor tyrosine-based activation motifs (ITAMs) that serve as the nucleating point for the intracellular signal transduction machinery upon T cell receptor engagement.

A number of therapeutic strategies modulate T cell immunity by targeting TCR signaling, particularly the anti-human CD3 monoclonal antibodies (mAbs) that are widely used clinically in immunosuppressive regimes. The CD3-specific mouse mAb OKT3 was the first mAb licensed for use in humans (Sgro, C. Side-effects of a monoclonal antibody, muromonab CD3/orthoclone OKT3: bibliographic review. Toxicology 105:23-29, 1995) and is widely used clinically as an immunosuppressive agent in transplantation (Chatenoud, Clin. Transplant 7:422-430, (1993); Chatenoud, Nat. Rev. Immunol. 3:123-132 (2003); Kumar, Transplant. Proc. 30:1351-1352 (1998)), type 1 diabetes, and psoriasis. Importantly, anti-CD3 mAbs can induce partial T cell signaling and clonal anergy (Smith, JA, Nonmitogenic Anti-CD3 Monoclonal Antibodies Deliver a Partial T Cell Receptor Signal and Induce Clonal Anergy J. Exp. Med. 185:1413-1422 (1997)). OKT3 has been described in the literature as a T cell mitogen as well as a potent T cell killer (Wong, JT. The mechanism of anti-CD3 monoclonal antibodies. Mediation of cytolysis by inter-T cell bridging. Transplantation 50:683-689 (1990)). In particular, the studies of Wong demonstrated that by bridging CD3 T cells and target cells, one could achieve killing of the target and that neither FcR-mediated ADCC nor complement fixation was necessary for bivalent anti-CD3 MAB to lyse the target cells.

OKT3 exhibits both a mitogenic and T-cell killing activity in a time-dependent fashion; following early activation of T cells leading to cytokine release, upon further administration OKT3 later blocks all known T-cell functions. It is due to this later blocking of T cell function that OKT3 has found such wide application as an immunosuppressant in therapy regimens for reduction or even abolition of allograft tissue rejection. Other antibodies specific for the CD3 molecule are disclosed in Tunnacliffe, Int. Immunol. 1 (1989), 546-50, WO2005/118635 and WO2007/033230 describe anti-human monoclonal CD3 epsilon antibodies, U.S. Pat. No. 5,821,337 describes the VL and VH sequences of murine anti-CD3 monoclonal Ab UCHT1 (muxCD3, Shalaby et al., J. Exp. Med. 175, 217-225 (1992)) and a humanized variant of this antibody (hu UCHT1), and United States Patent Application 20120034228 discloses binding domains capable of binding to an epitope of human and non-chimpanzee primate CD3 epsilon chain.

TABLE 6a

Anti-CD3 Monoclonal Antibodies and Sequences

| Clone Name | Antibody Name | Target | VH Sequence | SEQ ID NO. | VL Sequence | SEQ ID NO. |
|---|---|---|---|---|---|---|
| huOKT3 | | CD3 | QVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSS | 301 | DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITR | 351 |
| huUCHT1 | | CD3 | EVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSS | 302 | DIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIK | 352 |
| hu12F6 | | CD3 | QVQLVQSGGGVVQPGRSLRLSCKASGYTFTSYTMHWVRQAPGKGLEWIGYINPSSGYTKYNQKFKDRFTISADKSKSTAFLQMDSLRPEDTGVYFCARWQDYDVYFDYWGQGTPVTVSS | 303 | DIQMTQSPSSLSASVGDRVTMTCRASSSVSYMHWYQQTPGKAPKPWIYATSNLASGVPSRFSGSGSGTDYTLTISSLQPEDIATYYCQQWSSNPPTFGQGTKLQITR | 353 |
| mOKT3 | | CD3 | QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS | 304 | QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR | 354 |
| MT103 | blinatumomab | CD3 | DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS | 305 | DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK | 355 |

TABLE 6a-continued

Anti-CD3 Monoclonal Antibodies and Sequences

| Clone Name | Antibody Name | Target | VH Sequence | SEQ ID NO. | VL Sequence | SEQ ID NO. |
|---|---|---|---|---|---|---|
| MT110 | solitomab | CD3 | DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS | 306 | DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK | 356 |
| CD3.7 | | CD3 | EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS | 307 | QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL | 357 |
| CD3.8 | | CD3 | EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS | 308 | QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL | 358 |
| CD3.9 | | CD3 | EVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS | 309 | ELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVL | 359 |
| CD3.10 | | CD3 | EVKLLESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSS | 310 | QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL | 360 |

*underlined sequences, if present, are CDRs within the VL and VH

CD3 Cell Antigen Binding Fragments

In some embodiments, the disclosure relates to antigen binding fragments (AF1) having specific binding affinity for an effector cell antigen that can be incorporated into any of the subject composition embodiments described herein. In some cases, the effector cell antigen is expressed on the surface of an effector cell that is a plasma cell, a T cell, a B cell, a cytokine induced killer cell (CIK cell), a mast cell, a dendritic cell, a regulatory T cell (RegT cell), a helper T cell, a myeloid cell, or a NK cell.

Various AF1 that bind effector cell antigens have particular utility for pairing with an antigen binding fragment with binding affinity to HER2 antigens associated with a diseased cell or tissue in composition formats in order to effect cell killing of the diseased cell or tissue. Binding specificity can be determined by complementarity determining regions, or CDRs, such as light chain CDRs or heavy chain CDRs. In many cases, binding specificity is determined by light chain CDRs and heavy chain CDRs. A given combination of heavy chain CDRs and light chain CDRs provides a given binding pocket that confers greater affinity and/or specificity towards an effector cell antigen as compared to other reference antigens. The resulting bispecific compositions, having a first antigen binding fragment (AF1) to HER2 linked by a short, flexible peptide linker to a second antigen binding fragment (AF2) with binding specificity to an effector cell antigen are bispecific, with each antigen binding fragment having specific binding affinity to their respective ligands. It will be understood that in such compositions, an AF2 directed against a HER2 of a disease tissue is used in combination with a AF1 directed towards an effector cell marker in order to bring an effector cell in close proximity to the cell of a disease tissue in order to effect the cytolysis of the cell of the diseased tissue. Further, the AF1 and AF2 are incorporated into the specifically designed polypeptides comprising cleavable release segments and XTEN in order to confer prodrug characteristics on the compositions that becomes activated by release of the fused AF1 and AF2 upon the cleavage of the release segments when in proximity to the disease tissue having proteases capable of cleaving the release segments in one or more locations in the release segment sequence.

In one embodiment, the AF1 of the subject compositions has binding affinity for an effector cell antigen expressed on the surface of a T cell. In some embodiments, the AF1 of the subject compositions has binding affinity for CD3. In some embodiments, the AF1 of the subject compositions has binding affinity for a member of the CD3 complex, which includes in individual form or independently combined form all known CD3 subunits of the CD3 complex; for example, CD3 epsilon, CD3 delta, CD3 gamma, and CD3 zeta. In some embodiments, the AF1 has binding affinity for CD3 epsilon, CD3 delta, CD3 gamma, or CD3 zeta.

The origin of the antigen binding fragments contemplated by the disclosure can be derived from a naturally occurring antibody or fragment thereof, a non-naturally occurring antibody or fragment thereof, a humanized antibody or fragment thereof, a synthetic antibody or fragment thereof, a hybrid antibody or fragment thereof, or an engineered antibody or fragment thereof. Methods for generating an antibody for a given target marker are well known in the art. For example, the monoclonal antibodies may be made using the hybridoma method first described by Kohler et al., *Nature,* 256:495 (1975), or may be made by recombinant DNA methods (U.S. Pat. No. 4,816,567). The structure of antibodies and fragments thereof, variable regions of heavy and light chains of an antibody (VH and VL), single chain variable regions (scFv), complementarity determining regions (CDR), and domain antibodies (dAbs) are well understood. Methods for generating a polypeptide having a desired antigen binding fragment with binding affinity to a given antigen are known in the art.

It will be understood that use of the term "antigen binding fragments" for the composition embodiments disclosed herein is intended to include portions or fragments of antibodies that retain the ability to bind the antigens that are the ligands of the corresponding intact antibody. In such embodiments, the antigen binding fragment can be, but is not limited to, CDRs and intervening framework regions, variable or hypervariable regions of light and/or heavy chains of an antibody (VL, VH), variable fragments (Fv), Fab' fragments, F(ab')2 fragments, Fab fragments, single chain antibodies (scAb), VHH camelid antibodies, single chain variable fragment (scFv), linear antibodies, a single domain antibody, complementarity determining regions (CDR), domain antibodies (dAbs), single domain heavy chain immunoglobulins of the BHH or BNAR type, single domain light chain immunoglobulins, or other polypeptides known in the art containing a fragment of an antibody capable of binding an antigen. The antigen binding fragments having CDR-H and CDR-L can be configured in a (CDR-H)-(CDR-L) or a (CDR-H)-(CDR-L) orientation, N-terminus to C-terminus. The VL and VH of two antigen binding fragments can also be configured in a single chain diabody configuration; i.e., the VL and VH of the AF1 and AF2 configured with linkers of an appropriate length to permit arrangement as a diabody.

Various CD3 binding AF1 of the disclosure have been specifically modified to enhance their stability in the polypeptide embodiments described herein. Protein aggregation of antibodies continues to be a significant problem in their developability and remains a major area of focus in antibody production. Antibody aggregation can be triggered by partial unfolding of its domains, leading to monomer-monomer association followed by nucleation and aggregate growth. Although the aggregation propensities of antibodies and antibody-based proteins can be affected by the external experimental conditions, they are strongly dependent on the intrinsic antibody properties as determined by their sequences and structures. Although it is well known that proteins are only marginally stable in their folded states, it is often less well appreciated that most proteins are inherently aggregation-prone in their unfolded or partially unfolded states, and the resulting aggregates can be extremely stable and long-lived. Reduction in aggregation propensity has also been shown to be accompanied by an increase in expression titer, showing that reducing protein aggregation is beneficial throughout the development process and can lead to a more efficient path to clinical studies. For therapeutic proteins, aggregates are a significant risk factor for deleterious immune responses in patients, and can form via a variety of mechanisms. Controlling aggregation can improve protein stability, manufacturability, attrition rates, safety, formulation, titers, immunogenicity, and solubility. The intrinsic properties of proteins such as size, hydrophobicity, electrostatics and charge distribution play important roles in protein solubility. Low solubility of therapeutic proteins due to surface hydrophobicity has been shown to render formulation development more difficult and may lead to poor bio-distribution, undesirable pharmacokinetics behavior and immunogenicity in vivo. Decreasing the overall surface hydrophobicity of candidate monoclonal antibodies can also provide benefits and cost savings relating to purification and dosing regimens. Individual amino acids can be identified by structural analysis as being contributory to aggregation potential in an antibody, and can be located in CDR as well as framework regions. In particular, residues can be predicted to be at high risk of causing hydrophobicity issues in a given antibody. In one embodiment, the present disclosure provides an AF1 having the capability to specifically bind CD3 in which the AF1 has at least one amino acid substitution of a hydrophobic amino acid in a framework region relative to the parental antibody or antibody fragment wherein the hydrophobic amino acid is isoleucine, leucine or methionine. In some embodiments, the CD3 AF1 has at least two amino acid substitutions of hydrophobic amino acids in one or more framework regions wherein the hydrophobic amino acids are isoleucine, leucine or methionine.

The isoelectric point (pI) is the pH at which the antibody or antibody fragment has no net electrical charge. If the pH is below the pI of an antibody or antibody fragment, then it will have a net positive charge. A greater positive charge tends to correlate with increased blood clearance and tissue retention, with a generally shorter half-life. If the pH is greater than the pI of an antibody or antibody fragment it will have a negative charge. A negative charge generally results in decreased tissue uptake and a longer half-life. It is possible to manipulate this charge through mutations to the framework residues. These considerations informed the design of the sequences of the AF1 of the embodiments described herein wherein individual amino acid substitutions were made relative to the parental antibody utilized as the starting point. The isoelectric point of a polypeptide can be determined mathematically (e.g., computationally) or experimentally in an in vitro assay. The isoelectric point (pI) is the pH at which a protein has a net charge of zero and can be calculated using the charges for the specific amino acids in the protein sequence. Estimated values for the charges are called acid dissociation constants or pKa values and are used to calculate the pI. The pI can be determined in vitro by methods such as capillary isoelectric focusing (see Datta-Mannan, A., et al. The interplay of non-specific binding, target-mediated clearance and FcRn interactions on the pharmacokinetics of humanized antibodies. mAbs 7:1084 (2015); Li, B., et al. Framework selection can influence pharmacokinetics of a humanized therapeutic antibody through differences in molecule charge. mAbs 6, 1255-1264 (2014)) or other methods known in the art. In some embodiments, the isoelectric points of the AF1 and AF2 are designed to be within a particular range of each other, thereby promoting stability.

In one embodiment, the present disclosure provides an antigen binding fragment (e.g., AF1 or AF2) for use in any of the polypeptide embodiments described herein comprising CDR-L and CDR-H (see Table 6b), wherein the antigen binding fragment (e.g., AF1 or AF2) (a) specifically binds to cluster of differentiation 3 T cell receptor (CD3); and (b) comprises CDR-H1, CDR-H2, and CDR-H3, having amino acid sequences of SEQ ID NOS: 8, 9, and 10, respectively. In some embodiments, the CDR-H1 and the CDR-H2 of the antigen binding fragment (AF) can comprise amino acid sequences of SEQ ID NOS: 8 and 9, respectively. In some embodiments, the present disclosure provides an antigen binding fragment (e.g., AF1 or AF2) for use in any of the polypeptide embodiments described herein comprising CDR-L and CDR-H, wherein the antigen binding fragment (e.g., AF1 or AF2) (a) specifically binds to cluster of differentiation 3 T cell receptor (CD3); (b) comprises CDR-H1, CDR-H2, and CDR-H3, having amino acid sequences of SEQ ID NOS: 8, 9, and 10, respectively. The antigen binding fragment (e.g., AF1 or AF2) can comprise CDR-L, wherein the CDR-L comprises a CDR-L1 having an amino acid sequence of SEQ ID NOS: 1 or 2, a CDR-L2 having an amino acid sequence of SEQ ID NOS: 4 or 5, and a CDR-L3 having an amino acid sequence of SEQ ID NO:6. In some embodiments, where the peptide comprises an antigen binding fragment (AF) (e.g., AF1 or AF2) comprising a CDR-L1, a CDR-L2, and a CDR-L3, the CDR-L1 of the AF can comprise an amino acid sequence of SEQ ID NO:1 or 2; the CDR-L2 of the AF can comprise an amino acid sequence of SEQ ID NO: 4 or 5; and said CDR-L3 of the AF can comprise an amino acid sequence of SEQ ID NO:6. In some embodiments, where the peptide comprises an antigen binding fragment (AF) (e.g., AF1 or AF2) comprising a CDR-L1, a CDR-L2, and a CDR-L3, the CDR-L1 of the AF can comprise an amino acid sequence of SEQ ID NO:1; the CDR-L2 of the AF can comprise an amino acid sequence of SEQ ID NO: 4 or 5; and said CDR-L3 of the AF can comprise an amino acid sequence of SEQ ID NO:6. In some embodiments, where the peptide comprises an antigen binding fragment (AF) (e.g., AF1 or AF2) comprising a CDR-L1, a CDR-L2, and a CDR-L3, the CDR-L1 of the AF can comprise an amino acid sequence of SEQ ID NO: 2; the CDR-L2 of the AF can comprise an amino acid sequence of SEQ ID NO: 4 or 5; and said CDR-L3 of the AF can comprise an amino acid sequence of SEQ ID NO: 6. In some embodiments, where the peptide comprises an antigen binding fragment (AF) (e.g., AF1 or AF2) comprising a CDR-L1, a CDR-L2, and a CDR-L3, the CDR-L1 of the AF can comprise an amino acid sequence of SEQ ID NO: 1; the CDR-L2 of the AF can comprise an amino acid sequence of SEQ ID NO: 4; and said CDR-L3 of the AF can comprise an amino acid sequence of SEQ ID NO: 6. In some embodiments, where the peptide comprises an antigen binding fragment (AF) (e.g., AF1 or AF2) comprising a CDR-L1, a CDR-L2, and a CDR-L3, the CDR-L1 of the AF can comprise an amino acid sequence of SEQ ID NO: 2; the CDR-L2 of the AF can comprise an amino acid sequence of SEQ ID NO: 5; and said CDR-L3 of the AF can comprise an amino acid sequence of SEQ ID NO:6.

In some embodiments, the foregoing antigen binding fragment (AF) (e.g., AF1 or AF2) embodiments of the immediately preceding paragraph further comprises light chain framework regions (FR-L) and heavy chain framework regions (FR-H) (see Table 6c) wherein the antigen binding fragment (AF) can comprise a FR-L1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:51, a FR-L2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:52, a FR-L3 exhibiting at least 86%, 87%, 88%, 89%, 90%, 91%, 92%, 93%, 94%, 95%, 96%, 97%, 98%, 99% sequence identity or is identical to the amino acid sequence of any one of SEQ ID NOS: 53-56, a FR-L4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 59. The antigen binding fragment (AF) can comprise a FR-L1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:51, a FR-L2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:52, a FR-L3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 53, a FR-L4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 59. The antigen binding fragment (AF) can comprise a FR-L1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:51, a FR-L2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:52, a FR-L3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 54, a FR-L4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 59. The antigen binding fragment (AF) can comprise a FR-L1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:51, a FR-L2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:52, a FR-L3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 55, a FR-L4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 59. The antigen binding fragment (AF) can comprise a FR-L1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:51, a FR-L2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:52, a FR-L3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 56, a FR-L4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 59. The antigen binding fragment (AF) can comprise a FR-H1 exhibiting at least 86%, 87%, 88%, 89%, 90%, 91%, 92%, 93%, 94%, 95%, 96%, 97%, 98%, 99% sequence identity or is identical to the amino acid sequence of any one of SEQ ID NOS: 60-63, a FR-H2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 64, a FR-H3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 65 or 66; and a FR-H4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 67. The antigen binding fragment (AF) can comprise a FR-H1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 60, a FR-H2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 64, a FR-H3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 65; and a FR-H4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 67. The antigen binding fragment (AF) can comprise a FR-H1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 61, a FR-H2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 64, a FR-H3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 65; and a FR-H4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 67. The antigen binding fragment (AF) (e.g., AF1 or AF2) for use in any of the polypeptide embodiments described herein can comprise light chain framework regions (FR-L) and heavy chain framework regions (FR-H) wherein the AF can comprise a FR-L1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 51; a FR-L2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 52; a FR-L3 exhibiting at least 86%, 87%, 88%, 89%, 90%, 91%, 92%, 93%, 94%, 95%, 96%, 97%, 98%, 99% sequence identity or is identical to the amino acid sequence of any one of SEQ ID NOS: 53-56; a FR-L4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 59; a FR-H1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 60 or 61; a FR-H2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 64; a FR-H3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 65; and a FR-H4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 67. The AF can comprise a FR-L1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 51; a FR-L2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 52; a FR-L3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 53; a FR-L4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 59; a FR-H1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 60; a FR-H2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 64; a FR-H3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 65; and a FR-H4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 67. The AF can comprise a FR-L1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 51; a FR-L2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 52; a FR-L3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 54; a FR-L4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 59; a FR-H1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 61; a FR-H2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 64; a FR-H3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 65; and a FR-H4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 67. The AF can comprise a FR-L1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 51; a FR-L2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 52; a FR-L3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 55; a FR-L4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 59; a FR-H1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 61; a FR-H2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 64; a FR-H3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 65; and a FR-H4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 67. The AF can comprise a FR-L1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 51; a FR-L2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 52; a FR-L3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 56; a FR-L4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 59; a FR-H1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 61; a FR-H2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 64; a FR-H3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 65; and a FR-H4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO: 67.

In some embodiments, the present disclosure provides an antigen binding fragment (AF) (e.g., AF1 or AF2) for use in any of the polypeptide embodiments described herein wherein the AF comprises a variable heavy (VH) amino acid sequence having at least 90%, 91%, 92%, 93%, 94%, 95%, 96%, 97%, 98%, 99% sequence identity or is identical to an amino acid sequence of SEQ ID NO: 102 or SEQ ID NO: 105 of Table 6d. In some embodiments, the present disclosure provides an AF for use in any of the polypeptide embodiments described herein wherein the AF comprises a variable light (VL) amino acid sequence having at least 90%, 91%, 92%, 93%, 94%, 95%, 96%, 97%, 98%, 99% sequence identity or is identical to an amino acid sequence of any one of SEQ ID NOS: 101, 103, 104, 106, or 107 of Table 6d. In some embodiment, the present disclosure provides an antigen binding fragment (e.g., AF1 or AF2) for use in any of the polypeptide embodiments described herein wherein the AF can comprise an amino acid sequence having at least 95%, 96%, 97%, 98%, 99% sequence identity or is identical to an amino acid sequence of any one of SEQ ID NOS: 201-205 of Table 6e.

In some embodiments, the present disclosure provides antigen binding fragment (e.g., AF1 or AF2) that bind to the CD3 protein complex that have enhanced stability compared to CD3 binding antibodies or antigen binding fragments known in the art. Additionally, the CD3 antigen binding fragments of the disclosure are designed to confer a higher degree of stability on the chimeric bispecific antigen binding fragment compositions into which they are integrated, leading to improved expression and recovery of the fusion protein, increased shelf-life and enhanced stability when administered to a subject. In one approach, the CD3 AF of the present disclosure are designed to have a higher degree of thermal stability compared to certain CD3-binding antibodies and antigen binding fragments known in the art. As a result, the CD3 AF utilized as components of the chimeric bispecific antigen binding fragment compositions into which they are integrated exhibit favorable pharmaceutical properties, including high thermostability and low aggregation propensity, resulting in improved expression and recovery during manufacturing and storage, as well promoting long serum half-life. Biophysical properties such as thermostability are often limited by the antibody variable domains, which differ greatly in their intrinsic properties. High thermal stability is often associated with high expression levels and other desired properties, including being less susceptible to aggregation (Buchanan A, et al. Engineering a therapeutic IgG molecule to address cysteinylation, aggregation and enhance thermal stability and expression. MAbs 2013; 5:255). Thermal stability is determined by measuring the "melting temperature" ($T_m$), which is defined as the temperature at which half of the molecules are denatured. The melting temperature of each heterodimer is indicative of its thermal stability. In vitro assays to determine $T_m$ are known in the art, including methods described in the Examples, below. The melting point of the heterodimer may be measured using techniques such as differential scanning calorimetry (Chen et al (2003) Pharm Res 20:1952-60; Ghirlando et al (1999) Immunol Lett 68:47-52). Alternatively, the thermal stability of the heterodimer may be measured using circular dichroism (Murray et al. (2002) J. Chromatogr Sci 40:343-9), or as described in the Examples, below.

In some embodiments of the polypeptides of this disclosure, the antigen binding fragment (e.g., AF1 or AF2) can exhibit a higher thermal stability than an anti-CD3 binding fragment consisting of a sequence of SEQ ID NO: 206 (see Table 6e), as evidenced in an in vitro assay by a higher melting temperature ($T_m$) of the first antigen binding fragment relative to that of the anti-CD3 binding fragment; or upon incorporating the first antigen binding fragment into a test bispecific antigen binding construct, a higher $T_m$ of the test bispecific antigen binding construct relative to that of a control bispecific antigen binding construct, wherein the test bispecific antigen binding construct comprises the first antigen binding fragment and a reference antigen binding fragment that binds to an antigen other than CD3; and wherein the control bispecific antigen binding construct consists of the anti-CD3 binding fragment consisting of the sequence of SEQ ID NO:206 (see Table 6e) and the reference antigen binding fragment. The melting temperature ($T_m$) of the first antigen binding fragment can be at least 2° C. greater, or at least 3° C. greater, or at least 4° C. greater, or at least 5° C. greater than the $T_m$ of the anti-CD3 binding fragment consisting of the sequence of SEQ ID NO: 206 (see Table 6e).

Thermal denaturation curves of the CD3 binding fragments and the anti-CD3 bispecific antibodies comprising the anti-CD3 binding fragment and a reference binding of the present disclosure show that the constructs of the present disclosure are more resistant to thermal denaturation than the antigen binding fragment consisting of a sequence shown in SEQ ID NO: 781 (see Table 6f) or a control bispecific antibody wherein the control bispecific antigen binding fragment comprises SEQ ID NO: 781 (see Table 6f) and a reference antigen binding fragment that binds to a HER2 embodiment described herein. In one embodiment, the polypeptides of any of the subject composition embodiments described herein comprise an anti-CD3 AF of the embodiments described herein, wherein the $T_m$ of the AF is at least 2° C. greater, or at least 3° C. greater, or at least 4° C. greater, or at least 5° C. greater, or at least 6° C. greater, or at least 7° C. greater, or at least 8° C. greater, or at least 9° C. greater, or at least 10° C. greater than the $T_m$ of an antigen binding fragment consisting of a sequence of SEQ ID NO: 781 (see Table 6f), as determined by an increase in melting temperature in an in vitro assay.

In some embodiments, the polypeptides of any of the subject composition embodiments described herein comprise an antigen binding fragment (AF) that specifically bind human or cynomolgus monkey (cyno) CD3. The antigen binding fragment (AF) can specifically bind human CD3. The antigen binding fragment (AF) can bind a CD3 complex subunit identified herein as CD3 epsilon, CD3 delta, CD3 gamma, or CD3 zeta unit of CD3. The antigen binding fragment (AF) can bind a CD3 epsilon fragment of CD3. The antigen binding fragment (AF) can specifically bind human or cyno CD3 with a dissociation constant ($K_d$) constant between about 10 nM and about 400 nM, or between about 50 nM and about 350 nM, or between about 100 nM and 300 nM, as determined in an in vitro antigen-binding assay comprising a human or cyno CD3 antigen. In some embodiments, the polypeptides of any of the subject composition embodiments described herein comprise an antigen binding fragment (AF) that specifically binds human or cyno CD3 with a dissociation constant ($K_d$) weaker than about 10 nM, or about 50 nM, or about 100 nM, or about 150 nM, or about 200 nM, or about 250 nM, or about 300 nM, or about 350 nM, or weaker than about 400 nM as determined in an in vitro antigen-binding assay. For clarity, an antigen binding fragment (AF) with a $K_d$ of 400 binds its ligand more weakly than one with a $K_d$ of 10 nM. In some embodiments, the polypeptides of any of the subject composition embodiments described herein comprise an antigen binding fragment (AF) that specifically binds human or cyno CD3 with at least 2-fold, 3-fold, 4-fold, 5-fold, 6-fold, 7-fold, 8-fold, 9-fold, or at least 10-fold weaker binding affinity than an antigen binding fragment consisting of an amino acid sequence of SEQ ID NO: 781 (see Table 6f), as determined by the respective dissociation constants ($K_d$) in an in vitro antigen-binding assays. In some embodiments, the present disclosure provides bispecific polypeptides comprising an antigen binding fragment (AF) that exhibits a binding affinity to CD3 (anti-CD3 AF) that is at least 2-fold, 3-fold, 4-fold, 5-fold, 6-fold, 7-fold, 8-fold, 9-fold, 10-fold, 20-fold, 50-fold, 100-fold, or at least 1000-fold at weaker relative to that of an anti-HER2 AF embodiments described herein that are incorporated into the subject polypeptides, as determined by the respective dissociation constants ($K_d$) in an in vitro antigen-binding assay. The binding affinity of the subject compositions for the target ligands can be assayed using binding or competitive binding assays, such as Biacore assays with chip-bound receptors or binding proteins or ELISA assays, as described in U.S. Pat. No. 5,534,617, assays described in the Examples herein, radio-receptor assays, or other assays known in the art. The binding affinity constant can then be determined using standard methods, such as Scatchard analysis, as described by van Zoelen, et al., Trends Pharmacol Sciences (1998) 19)12):487, or other methods known in the art.

In a related aspect, the present disclosure provides an antigen binding fragment (AF) that bind to CD3 (anti-CD3 AF) and are incorporated into chimeric, bispecific polypeptide compositions that are designed to have an isoelectric point (pI) that confer enhanced stability on the compositions of the disclosure compared to corresponding compositions comprising CD3 binding antibodies or antigen binding fragments known in the art. In one embodiment, the polypeptides of any of the subject composition embodiments described herein comprise AF that bind to CD3 (anti-CD3 AF) wherein the anti-CD3 AF exhibits a pI that is between 6.0 and 6.6, inclusive. In some embodiments, the polypeptides of any of the subject composition embodiments described herein comprise AF that bind to CD3 (anti-CD3 AF) wherein the anti-CD3 AF exhibits a pI that is at least 0.1, 0.2, 0.3, 0.4, 0.5, 0.6, 0.7, 0.8, 0.9, or 1.0 pH unit lower than the pI of a reference antigen binding fragment (e.g., consisting of a sequence shown in SEQ ID NO: 206 (see Table 6e)). In some embodiments, the polypeptides of any of the subject composition embodiments described herein comprise an AF that binds to CD3 (anti-CD3 AF) fused to another AF that binds to a HER2 antigen (anti-HER2 AF) wherein the anti-CD3 AF exhibits a pI that is within at least 0.1, 0.2, 0.3, 0.4, 0.5, 0.6, 0.7, 0.8, 0.9, 1.0, 1.1, 1.2, 1.3, 1.4, or 1.5 pH units of the pI of the AF that binds HER2 antigen or an epitope thereof. In some embodiments, the polypeptides of any of the subject composition embodiments described herein comprise an AF that binds to CD3 (anti-CD3 AF) fused to an AF that binds to a HER2 antigen (anti-HER2 AF) wherein the AF exhibits a pI that is within at least about 0.1 to about 1.5, or at least about 0.3 to about 1.2, or at least about 0.5 to about 1.0, or at least about 0.7 to about 0.9 pH units of the pI of the anti-CD3 AF. It is specifically intended that by such design wherein the pI of the two antigen binding fragments are within such ranges, the resulting fused antigen binding fragments will confer a higher degree of stability on the chimeric bispecific antigen binding fragment compositions into which they are integrated, leading to improved expression and enhanced recovery of the fusion protein in soluble, non-aggregated form, increased shelf-life of the formulated chimeric bispecific polypeptide compositions, and enhanced stability when the composition is administered to a subject. State differently, having the two AFs (the anti-CD3 AF and the anti-HER2 AF) within a relatively narrow pI range of may allow for the selection of a buffer or other solution in which both the AFs (anti-CD3 AF and anti-HER2 AF) are stable, thereby promoting overall stability of the composition. The antigen binding fragment (AF) can exhibit an isoelectric point (pI) that is less than or equal to 6.6. The antigen binding fragment (AF) can exhibit an isoelectric point (pI) that is between 6.0 and 6.6, inclusive. The antigen binding fragment (AF) can exhibit an isoelectric point (pI) that is at least 0.1, 0.2, 0.3, 0.4, 0.5, 0.6, 0.7, 0.8, 0.9, or 1.0 pH units lower than the pI of a reference antigen binding fragment consisting of a sequence shown in SEQ ID NO: 206 (see Table 6e).

The antigen binding fragment (AF) can specifically bind human or cyno CD3 with a dissociation constant ($K_d$) constant between about between about 10 nM and about 400 nM (such as determined in an in vitro antigen-binding assay comprising a human or cyno CD3 antigen). The antigen binding fragment (AF) can specifically bind human or cyno CD3 with a dissociation constant ($K_d$) of less than about 10 nM, or less than about 50 nM, or less than about 100 nM, or less than about 150 nM, or less than about 200 nM, or less than about 250 nM, or less than about 300 nM, or less than about 350 nM, or less than about 400 nM (such as determined in an in vitro antigen-binding assay). The antigen binding fragment (AF) can exhibit a binding affinity to CD3 that is at least 2-fold, 3-fold, 4-fold, 5-fold, 6-fold, 7-fold, 8-fold, 9-fold, or at least 10-fold weaker relative to that of an antigen binding fragment consisting of an amino acid sequence of SEQ ID NO: 206 (see Table 6e) (such as determined by the respective dissociation constants ($K_d$) in an in vitro antigen-binding assay).

In certain embodiments, the VL and VH of the antigen binding fragments are fused by relatively long linkers, consisting 25, 26, 27, 28, 29, 30, 31, 32, 33, 34, or 35 hydrophilic amino acids that, when joined together, have a flexible characteristic. In one embodiment, the VL and VH of any of the scFv embodiments described herein are linked by relatively long linkers of hydrophilic amino acids having the sequences GSGEGSEGEGGGEGSEGEGSGEGGEGEGSG (SEQ ID NO: 82), TGSGEGSEGEGGGEGSEGEGSGEGGEGEGSGT (SEQ ID NO: 83), GATPPETGAETESPGETTGGSAESEPPGEG (SEQ ID NO: 84), or GSAAPTAGTTPSASPAPPTGGS-SAAGSPST (SEQ ID NO: 85). In some embodiments, the AF1 and AF2 are linked together by a short linker of hydrophilic amino acids having 3, 4, 5, 6, or 7 amino acids. In one embodiment, the short linker sequences are identified herein as the sequences SGGGGS (SEQ ID NO: 86), GGGGS (SEQ ID NO: 87), GGSGGS (SEQ ID NO: 88), GGS, or GSP. In some embodiments, the disclosure provides compositions comprising a single chain diabody in which after folding, the first domain (VL or VH) is paired with the last domain (VH or VL) to form one scFv and the two domains in the middle are paired to form the other scFv in which the first and second domains, as well as the third and last domains, are fused together by one of the foregoing short linkers and the second and the third variable domains are fused by one of the foregoing relatively long linkers. As will be appreciated by one of skill in the art, the selection of the short linker and relatively long linker is to prevent the incorrect pairing of adjacent variable domains, thereby facilitating the formation of the single chain diabody configuration comprising the VL and VH of the first antigen binding fragment and the second antigen binding fragment.

TABLE 6b

Exemplary CD3 CDR Sequences

| Construct | CDR REGION | Amino Acid Sequence | SEQ ID NO: |
|---|---|---|---|
| 3.23, 3.30, 3.31, 3.32 | CDR-L1 | RSSNGAVTSSNYAN | 1 |
| 3.24 | CDR-L1 | RSSNGEVTTSNYAN | 2 |
| 3.33, 3.9 | CDR-L1 | RSSTGAVTTSNYAN | 3 |
| 3.23, 3.30, 3.31, 3.32, 3.9, 3.33 | CDR-L2 | GTNKRAP | 4 |
| 3.24 | CDR-L2 | GTIKRAP | 5 |
| 3.23, 3.24, 3.30, 3.31, 3.32 | CDR-L3 | ALWYPNLWVF | 6 |
| 3.33, 3.9 | CDR-L3 | ALWYSNLWVF | 7 |
| 3.23, 3.24, 3.30, 3.31, 3.32, 3.9, 3.33 | CDR-H1 | GFTFNTYAMN | 8 |
| 3.23, 3.24, 3.30, 3.31, 3.32, 3.9, 3.33 | CDR-H2 | RIRSKYNNYATYYADSVKD | 9 |
| 3.23. 3.24, 3.30, 3.31, 3.32 | CDR-H3 | HENFGNSYVSWFAH | 10 |
| 3.9, 3.33 | CDR-H3 | HGNFGNSYVSWFAY | 11 |

TABLE 6c

Exemplary CD3 FR Sequences

| Construct | FR REGION | Amino Acid Sequence | SEQ ID NO: |
|---|---|---|---|
| 3.23, 3.24, 3.30, 3.31, 3.32, 3.9, 3.33 | FR-L1 | ELVVTQEPSLTVSPGGTVTLTC | 51 |
| 3.23, 3.24, 3.30, 3.31, 3.32, 3.9, 3.33 | FR-L2 | WVQQKPGQAPRGLIG | 52 |

TABLE 6c-continued

Exemplary CD3 FR Sequences

| Construct | FR REGION | Amino Acid Sequence | SEQ ID NO: |
|---|---|---|---|
| 3.23, 3.24 | FR-L3 | GTPARFSGSLLGGKAALTLSGVQPEDEAVYYC | 53 |
| 3.30 | FR-L3 | GTPARFSGSSLGGKAALTLSGVQPEDEAVYYC | 54 |
| 3.31 | FR-L3 | GTPARFSGSLLGGSAALTLSGVQPEDEAVYYC | 55 |
| 3.32 | FR-L3 | GTPARFSGSSLGGSAALTLSGVQPEDEAVYYC | 56 |
| 3.9 | FR-L3 | GTPARFSGSLLGGKAALTLSGVQPEDEAEYYC | 57 |
| 3.33 | FR-L3 | GTPARFSGSSLGGSAALTLSGVQPEDEAEYYC | 58 |
| 3.23, 3.24, 3.30, 3.31, 3.32, 3.9, 3.33 | FR-L4 | GGGTKLTVL | 59 |
| 3.23, 3.24 | FR-H1 | EVQLLESGGGIVQPGGSLKLSCAAS | 60 |
| 3.30, 3.31, 3.32 | FR-H1 | EVQLQESGGGIVQPGGSLKLSCAAS | 61 |
| 3.33 | FR-H1 | EVQLQESGGGLVQPGGSLKLSCAAS | 62 |
| 3.9 | FR-H1 | EVQLLESGGGLVQPGGSLKLSCAAS | 63 |
| 3.23, 3.24, 3.30, 3.31, 3.32, 3.9, 3.33 | FR-H2 | WVRQAPGKGLEWVA | 64 |
| 3.23, 3.24, 3.30, 3.31, 3.32 | FR-H3 | RFTISRDDSKNTVYLQMNNLKTEDTAVYYCVR | 65 |
| 3.9, 3.33 | FR-H3 | RFTISRDDSKNTAYLQMNNLKTEDTAVYYCVR | 66 |
| 3.23, 3.24, 3.30, 3.31, 3.32, 3.9, 3.33 | FR-H4 | WGQGTLVTVSS | 67 |

TABLE 6d

Exemplary CD3 VL & VH Sequences

| Construct | REGION | Amino Acid Sequence | SEQ ID NO: |
|---|---|---|---|
| 3.23 | VL | ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVL | 101 |
| 3.23, 3.24 | VH | EVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS | 102 |
| 3.24 | VL | ELVVTQEPSLTVSPGGTVTLTCRSSNGEVTTSNYANWVQQKPGQAPRGLIGGTIKRAPGTPARFSGSLLGGKAALTLSGVQPEDEAVYYCALWYPNLWVFGGGTKLTVL | 103 |
| 3.30 | VL | ELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNLWVFGGGTKLTVL | 104 |
| 3.30, 3.31, 3.32 | VH | EVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS | 105 |
| 3.31 | VL | ELVVTQEPSLTVSPGGTVTLTCRSSNGAVTSSNYANWVQQKPGQAPRGLIGGTNKRAPGTPARFSGSLLGGSAALTLSGVQPEDEAVYYCALWYPNLWVFGGGTKLTVL | 106 |
| 3.32 | VL | ELVVTQEPSLTVSPGGTVTLTCRSSNGAVTSSNYANWVQQKPGQAPRGLIGGTNKRAPGTPARFSGSSLGGSAALTLSGVQPEDEAVYYCALWYPNLWVFGGGTKLTVL | 107 |

TABLE 6d-continued

Exemplary CD3 VL & VH Sequences

| Construct | REGION | Amino Acid Sequence | SEQ ID NO: |
|---|---|---|---|
| 3.9 | VL | ELVVTQEPSLTVSPGGTVTLTCRSSTGAVTTSNYANWVQQKPGQAP RGLIGGTNKRAPGTPARFSGSLLGGKAALTLSGVQPEDEAEYYCAL WYSNLWVFGGGTKLTVL | 108 |
| 3.9 | VH | EVQLLESGGGLVQPGGSLKLSCAASGFTFNTYAMNWVRQAPGKGL EWVARIRSKYNNYATYYADSVKDRFTISRDDSKNTAYLQMNNLKT EDTAVYYCVRHGNFGNSYVSWFAYWGQGTLVTVSS | 109 |
| 3.33 | VL | ELVVTQEPSLTVSPGGTVTLTCRSSTGAVTTSNYANWVQQKPGQAP RGLIGGTNKRAPGTPARFSGSSLGGSAALTLSGVQPEDEAEYYCAL WYSNLWVFGGGTKLTVL | 110 |
| 3.33 | VH | EVQLQESGGGLVQPGGSLKLSCAASGFTFNTYAMNWVRQAPGKGL EWVARIRSKYNNYATYYADSVKDRFTISRDDSKNTAYLQMNNLKT EDTAVYYCVRHGNFGNSYVSWFAYWGQGTLVTVSS | 111 |

TABLE 6e

Exemplary CD3 scFv Sequences

| Construct | Amino Acid Sequence | SEQ ID NO: |
|---|---|---|
| 3.23 | ELVVTQEPSLTVSPGGTVTLTCRSSNGAVTSSNYANWVQQKPGQAPRGLIGGTNK RAPGTPARFSGSLLGGKAALTLSGVQPEDEAVYYCALWYPNLWVFGGGTKLTVL GATPPETGAETESPGETTGGSAESEPPGEGEVQLLESGGGIVQPGGSLKLSCAASGF TFNTYAMNWVRQAPGKGLEWVARIRSKYNNYATYYADSVKDRFTISRDDSKNTV YLQMNNLKTEDTAVYYCVRHENFGNSYVSWFAHWGQGTLVTVSS | 201 |
| 3.24 | ELVVTQEPSLTVSPGGTVTLTCRSSNGEVTTSNYANWVQQKPGQAPRGLIGGTIKR APGTPARFSGSLLGGKAALTLSGVQPEDEAVYYCALWYPNLWVFGGGTKLTVLG ATPPETGAETESPGETTGGSAESEPPGEGEVQLLESGGGIVQPGGSLKLSCAASGFT FNTYAMNWVRQAPGKGLEWVARIRSKYNNYATYYADSVKDRFTISRDDSKNTV YLQMNNLKTEDTAVYYCVRHENFGNSYVSWFAHWGQGTLVTVSS | 202 |
| 3.30 | ELVVTQEPSLTVSPGGTVTLTCRSSNGAVTSSNYANWVQQKPGQAPRGLIGGTNK RAPGTPARFSGSSLGGKAALTLSGVQPEDEAVYYCALWYPNLWVFGGGTKLTVL GATPPETGAETESPGETTGGSAESEPPGEGEVQLQESGGGIVQPGGSLKLSCAASGF TFNTYAMNWVRQAPGKGLEWVARIRSKYNNYATYYADSVKDRFTISRDDSKNTV YLQMNNLKTEDTAVYYCVRHENFGNSYVSWFAHWGQGTLVTVSS | 203 |
| 3.31 | ELVVTQEPSLTVSPGGTVTLTCRSSNGAVTSSNYANWVQQKPGQAPRGLIGGTNK RAPGTPARFSGSLLGGSAALTLSGVQPEDEAVYYCALWYPNLWVFGGGTKLTVL GATPPETGAETESPGETTGGSAESEPPGEGEVQLQESGGGIVQPGGSLKLSCAASGF TFNTYAMNWVRQAPGKGLEWVARIRSKYNNYATYYADSVKDRFTISRDDSKNTV YLQMNNLKTEDTAVYYCVRHENFGNSYVSWFAHWGQGTLVTVSS | 204 |
| 3.32 | ELVVTQEPSLTVSPGGTVTLTCRSSNGAVTSSNYANWVQQKPGQAPRGLIGGTNK RAPGTPARFSGSSLGGSAALTLSGVQPEDEAVYYCALWYPNLWVFGGGTKLTVL GATPPETGAETESPGETTGGSAESEPPGEGEVQLQESGGGIVQPGGSLKLSCAASGF TFNTYAMNWVRQAPGKGLEWVARIRSKYNNYATYYADSVKDRFTISRDDSKNTV YLQMNNLKTEDTAVYYCVRHENFGNSYVSWFAHWGQGTLVTVSS | 205 |
| 3.9 | ELVVTQEPSLTVSPGGTVTLTCRSSTGAVTTSNYANWVQQKPGQAPRGLIGGTNK RAPGTPARFSGSLLGGKAALTLSGVQPEDEAEYYCALWYSNLWVFGGGTKLTVL GATPPETGAETESPGETTGGSAESEPPGEGEVQLLESGGGLVQPGGSLKLSCAASGF TFNTYAMNWVRQAPGKGLEWVARIRSKYNNYATYYADSVKDRFTISRDDSKNTA YLQMNNLKTEDTAVYYCVRHGNFGNSYVSWFAYWGQGTLVTVSS | 206 |
| 3.33 | ELVVTQEPSLTVSPGGTVTLTCRSSTGAVTTSNYANWVQQKPGQAPRGLIGGTNK RAPGTPARFSGSSLGGSAALTLSGVQPEDEAEYYCALWYSNLWVFGGGTKLTVLG ATPPETGAETESPGETTGGSAESEPPGEGEVQLQESGGGLVQPGGSLKLSCAASGFT FNTYAMNWVRQAPGKGLEWVARIRSKYNNYATYYADSVKDRFTISRDDSKNTA YLQMNNLKTEDTAVYYCVRHGNFGNSYVSWFAYWGQGTLVTVSS | 207 |
| 4.11 | QSVLTQPPSASGTPGQRVTISCSGSSSNIGSNYVYWYQQLPGTAPKLLIYRNNQRPS GVPDRFSGSKSGTSASLAISGLRSEDEADYYCAAWDDSLSGLWVFGGGTKLTVLG ATPPETGAETESPGETTGGSAESEPPGEGQVQLQQWGGGLVKPGGSLRLSCAASGF TFSSYSMNWVRQAPGKGLEWVSRINSDGSSTNYADSVKGRFTISRDNAKNTLYLQ MNSLRAEDTAVYYCARELRWGNWGQGTLVTVSS | 208 |

TABLE 6e-continued

Exemplary CD3 scFv Sequences

| Construct | Amino Acid Sequence | SEQ ID NO: |
|---|---|---|
| 4.12 | QAGLTQPPSASGTPGQRVTLSCSGSYSNIGTYYVYWYQQLPGTAPKLLIYSNDQRL SGVPDRFSGSKSGTSASLAISGLQSEDEAAYYCAAWDDSLNGWAFGGGTKLTVLG ATPPETGAETESPGETTGGSAESEPPGEGQVQLQQWGGGLVKPGGSLRLSCAASGF TFSSYSMNWVRQAPGKGLEWVSRINSDGSSTNYADSVKGRFTISRDNAKNTLYLQ MNSLRAEDTAVYYCARELRWGNWGQGTLVTVSS | 209 |
| 4.13 | QPGLTQPPSASGTPGQRVTLSCSGRSSNIGSYYVYWYQHLPGMAPKLLIYRNSRRP SGVPDRFSGSKSGTSASLVISGLQSDDEADYYCAAWDDSLKSWVFGGGTKLTVLG ATPPETGAETESPGETTGGSAESEPPGEGQVQLQQWGGGLVKPGGSLRLSCAASGF TFSSYSMNWVRQAPGKGLEWVSRINSDGSSTNYADSVKGRFTISRDNAKNTLYLQ MNSLRAEDTAVYYCARELRWGNWGQGTLVTVSS | 210 |
| 4.14 | QSVLTQPPSASGTPGQRVTISCSGSSSNIGTNYVYWYQQFPGTAPKLLIYSNNQRPS GVPDRFSGSKSGTSGSLAISGLQSEDEADYSCAAWDDSLNGWVFGGGTKLTVLGA TPPETGAETESPGETTGGSAESEPPGEGQVQLVQWGGGLVKPGGSLRLSCAASGFT FSSYSMNWVRQAPGKGLEWVSRINSDGSSTNYADSVKGRFTISRDNAKNTLYLQ MNSLRAEDTAVYYCARELRWGNWGQGTLVTVSS | 211 |
| 4.15 | QPGLTQPPSASGTPGQRVTISCSGSSSNIGSNYVYWYQQLPGTAPKLLIYRNNQRPS GVPDRLSGSKSGTSASLAISGLRSEDEADYYCAAWDDSLSGWVFGGGTKLTVLGA TPPETGAETESPGETTGGSAESEPPGEGQVQLVQWGGGLVKPGGSLRLSCAASGFT FSSYSMNWVRQAPGKGLEWVSRINSDGSSTNYADSVKGRFTISRDNAKNTLYLQ MNSLRAEDTAVYYCARELRWGNWGQGTLVTVSS | 212 |
| 4.16 | QAVLTQPPSASGTPGQRVTISCSGSSSNIGSYYVYWYQQVPGAAPKLLMRLNNQR PSGVPDRFSGAKSGTSASLVISGLRSEDEADYYCAAWDDSLSGQWVFGGGTKLTV LGATPPETGAETESPGETTGGSAESEPPGEGQVQLQQWGGGLVKPGGSLRLSCAAS GFTFSSYSMNWVRQAPGKGLEWVSRINSDGSSTNYADSVKGRFTISRDNAKNTLY LQMNSLRAEDTAVYYCARELRWGNWGQGTLVTVSS | 213 |
| 4.17 | QAGLTQPPSASGTPGQRVTISCSGSSSNIGSNYVYWYQQLPGTAPKLLIYRNNQRPS GVPDRFSGSKSGTSASLAISGLRSEDEADYYCATWDASLSGWVFGGGTKLTVLGA TPPETGAETESPGETTGGSAESEPPGEGEVQLVQWGGGLVKPGGSLRLSCAASGFT FSSYSMNWVRQAPGKGLEWVSRINSDGSSTNYADSVKGRFTISRDNAKNTLYLQ MNSLRAEDTAVYYCARELRWGNWGQGTLVTVSS | 214 |

Anti-HER-2 Binding Domains

In some embodiments, the invention provides chimeric polypeptide assembly compositions comprising a first portion binding domain with binding affinity to the tumor-specific marker HER-2 and a second binding domain binds to an effector cell antigen, such as CD3 antigen. In one embodiment, the binding domain comprises VL and VH derived form a monoclonal antibody to HER-2. Monoclonal antibodies to HER-2 are known in the art. Exemplary, non-limiting examples of VL and VH sequences are presented in Table 6f. In one embodiment, the invention provides a chimeric polypeptide assembly composition comprising a first portion binding domain with binding affinity to the tumor-specific marker HER-2 comprising anti-HER-2 VL and VH sequences set forth in Table 6f. In some embodiments, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences set forth in Table 6f. Preferably, in the embodiments, the binding has a $K_d$ value of greater than $10^{-10}$ to $10^{-7}$ M, as determined in an vitro binding assay. In some embodiments, where the polypeptide comprises an antigen binding fragment that specifically binds to HER2 (anti-HER2 AF), the anti-HER2 AF (e.g., AF1 or AF2) can comprise (1) a heavy chain variable region ($VH_{II}$) comprising an amino acid sequence set forth as SEQ ID NOS: 778-783, and (2) a light chain variable region ($VL_{II}$) comprising an amino acid sequence set forth as SEQ ID NOS: 878-883 of Table 6f. It is specifically contemplated that the chimeric polypeptide assembly composition can comprise any one of the foregoing binding domains or sequence variants thereof so long as the variants exhibit binding specificity for the described antigen. In one embodiment, a sequence variant would be created by substitution of an amino acid in the VL or VH sequence with a different amino acid. In deletion variants, one or more amino acid residues in a VL or VH sequence as described herein are removed. Deletion variants, therefore, include all fragments of a binding domain polypeptide sequence. In substitution variants, one or more amino acid residues of a VL or VH (or CDR) polypeptide are removed and replaced with alternative residues. In one aspect, the substitutions are conservative in nature and conservative substitutions of this type are well known in the art. In addition, it is specifically contemplated that the compositions comprising the first and the second binding domains disclosed herein can be utilized in any of the methods disclosed herein.

TABLE 6f

Anti-HER2 Monoclonal Antibodies and Sequences

| Trade Name | Antibody Name | Target | VH Sequence | SEQ ID NO: | VL Sequence | SEQ ID NO: |
|---|---|---|---|---|---|---|
| | C1 | HER2 | QVQLVESGGGLVQPGGSLRLSCAASGFTFSSYAMGWVRQAPGKGLEWVSSISGSSRYIYYADSVKGRFTISRDNSKNTLYLQMNSLRAEDTAVYYCAKMDASGSYFNFWGQGTLVTVSS | 778 | QSPSFLSAFVGDRITITCRASPGIRNYLAWYQQKPGKAPKLLIYAASTLQSGVPSRFSGSGSGTDFTLTISSLQPEDFATYYCQQYNSYPLSFGGGTKVEIK | 878 |
| Erbicin | | HER2 | QVQLLQSAAEVKKPGESLKISCKGSGYSFTSYWIGWVRQMPGKGLEWMGIIYPGDSDTRYSPSFQGQVTISADKSISTAYLQWSSLKASDTAVYYCARWRDSPLWGQGTLVTVSS | 779 | QAVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGQYVFGGGTKLTVL | 879 |
| Herceptin | trastuzumab | HER2 | EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS | 780 | DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIK | 880 |
| MAGH22 | margetuximab | HER2 | QVQLQQSGPELVKPGASLKLSCTASGFNIKDTYIHWVKQRPEQGLEWIGRIYPTNGYTRYDPKFQDKATITADTSSNTAYLQVSRLTSEDTAVYYCSRWGGDGFYAMDYWGQGASVTVSS | 781 | DIVMTQSHKFMSTSVGDRVSITCKASQDVNTAVAWYQQKPGHSPKLLIYSASFRYTGVPDRFTGSRSGTDFTFTISSVQAEDLAVYYCQQHYTTPPTFGGGTKVEIK | 881 |
| MM-302 | F5 | HER2 | QVQLVESGGGLVQPGGSLRLSCAASGFTFRSYAMSWVRQAPGKGLEWVSAISGRGDNTYYADSVKGRFTISRDNSKNTLYLQMNSLRAEDTAVYYCAKMTSNAFAFDYWGQGTLVTVSS | 782 | QSVLTQPPSVSGAPGQRVTISCTGSSSNIGAGYVHWYQQLPGTAPKLLIYGNTNRPSGVPDRFSGFKSGTSASLAITGLQAEDEADYYCQFYDSSLSGWVFGGGTKLTVL | 882 |
| Perjeta | pertuzumab | HER2 | EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSS | 783 | DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIK | 883 |

*underlined & bolded sequences, if present, are CDRs within the VL and VH

TABLE A

Intramolecular Long Linkers

| Linker # | Name | SEQ ID | Amino Acid Sequence |
|---|---|---|---|
| L1 | (G4S)3 | 112 | GGGGSGGGGSGGGGS |
| L2 | MT110_18 | 113 | GEGTSTGSGGSGGSGGAD |

TABLE A-continued

Intramolecular Long Linkers

| Linker # | Name | SEQ ID | Amino Acid Sequence |
|---|---|---|---|
| L3 | MT103_18 | 114 | VEGGSGGSGGSGGSGGVD |
| L4 | UCHT1_29 | 115 | RTSGPGDGGKGGPGKGPGGEGTKGTGPGG |
| L5 | Y30 | 116 | GSGEGSEGEGGGEGSEGEGSGEGGEGEGSG |
| L6 | Y32 | 117 | TGSGEGSEGEGGGEGSEGEGSGEGGEGEGSGT |
| L7 | G1_30_3 | 118 | GATPPETGAETESPGETTGGSAESEPPGEG |
| L8 | G9_30_1 | 119 | GSAAPTAGTTPSASPAPPTGGSSAAGSPST |
| L9 | Y30_modified | 120 | GEGGESGGSEGEGSGEGEGGSGGEGESEGG |
| L10 | G1_30_1 | 121 | STETSPSTPTESPEAGSGSGSPESPSGTEA |
| L11 | G1_30_2 | 122 | PTGTTGEPSGEGSEPEGSAPTSSTSEATPS |
| L12 | G1_30_4 | 123 | SESESEGEAPTGPGASTTPEPSESPTPETS |
| L13 | UCHT1_modified | 124 | PEGGESGEGTGPGTGGEPEGEGGPGGEGGT |

TABLE B

Intermolecular Short Linkers

| Name | Amino Acid Sequence |
|---|---|
| S-1 | SGGGGS (SEQ ID NO: 86) |
| S-2 | GGGGS (SE ID NO: 87) |
| S-3 | GGS |
| S-4 | GSP |

In some embodiments of the polypeptides of this disclosure, a pair of the light chain variable region (VL) and the heavy chain variable region (VH) of an antigen binding fragment can be linked by a linker, or a long linker (e.g., of hydrophilic amino acids). Such linker, linking the light chain variable region (VL) and the heavy chain variable region (VH) of an antigen binding fragment (e.g., a first antigen binding fragment (AF1), a second antigen binding fragment (AF2)), can (each independently) comprise an amino acid sequence having at least 90%, 91%, 92%, 93%, 94%, 95%, 96%, 97%, 98%, 99% or 10000 sequence identity to a sequence set forth in Table A. Such linker, linking the light chain variable region (VL) and the heavy chain variable region (VH) of an antigen binding fragment (e.g., a first antigen binding fragment (AF1), a second antigen binding fragment (AF2)), can (each independently) comprise an amino acid sequence identical to a sequence set forth in Table A. In some embodiments of the polypeptides of this disclosure, two antigen binding fragments (e.g., a first and a second antigen binding fragments) can be fused together by a peptide linker, or a short linker. Such peptide linker, linking two antigen binding fragments (e.g., a first and a second antigen binding fragments), can comprise an amino acid sequence having at least 90%, 91%, 92%, 93%, 94%, 95%, 96%, 97%, 98%, 99% or 100% sequence identity to a sequence set forth in Table B. Such peptide linker, linking two antigen binding fragments (e.g., a first and a second antigen binding fragments), can comprise an amino acid sequence identical to a sequence set forth in Table B. In some cases, the first antigen binding fragment is a single-chain variable fragment (scFv). In some cases, the second antigen binding fragment is a single-chain variable fragment (scFv). The two single-chain variable fragments of the first and second antigen binding fragments can be linked together by the peptide linker. In some embodiments of the polypeptides of this disclosure, the linker used to link the VL and VH of the first antigen binding fragment or/and the linker used to link the VL and VH of the second antigen binding fragment can be L7 of Table A. In such embodiments, the peptide linker used to link the two antigen binding fragments can be S-1 or S-2 of Table B. In some embodiments, the disclosure provides polypeptides comprising a single chain diabody in which after folding, the first domain (VL or VH) is paired with the last domain (VH or VL) to form one scFv and the two domains in the middle are paired to form the other scFv in which the first and second domains, as well as the third and last domains, are fused together by a short linker of hydrophilic amino acids identified herein by the sequences set forth in Table B and the second and the third variable domains are fused by a long linker identified in Table A. As will be appreciated by one of skill in the art, the selection of the short linker and long linker is to prevent the incorrect pairing of adjacent variable domains, thereby facilitating the formation of the single chain diabody configuration comprising the VL and VH of the first binding moiety and the second binding moiety.

TABLE C

Exemplary Spacers between a Release Segment and a Bispecific Antibody Construct

| Amino Acid Sequence | SEQ ID NO: |
|---|---|
| STEPS | 89 |
| SATPESGPGT | 90 |
| ATSGSETPGT | 91 |
| GTAEAASASG | 92 |

TABLE C-continued

Exemplary Spacers between a Release Segment and a Bispecific Antibody Construct

| Amino Acid Sequence | SEQ ID NO: |
|---|---|
| STEPSEGSAPGTS | 93 |
| SGPGTS | 94 |
| GTSTEPS | 95 |

In some embodiments of the polypeptides of this disclosure, a release segment (RS) (e.g., a first release segment (RS1), a second release segment (RS2), etc.) can be fused to a bispecific antibody construct (BsAb) by a spacer. Such spacer can (each independently) comprise at least 4 types of amino acids that are glycine (G), alanine (A), serine (S), threonine (T), glutamate (E) or proline (P). The peptides of this disclosure can comprise a first release segment fused to the bispecific antibody construct via a first spacer and a second release segment fused to the bispecific antibody construct via a second space. A spacer (e.g., a first spacer, a second spacer, etc.) can (each independently) comprise an amino acid sequence having at least (about) 80%, at least (about) 90%, or 100% sequence identity to a sequence set forth in Table C. The spacer (e.g., the first spacer, the second spacer, etc.) can (each independently) comprise an amino acid sequence identical to a sequence set forth in Table C.

Unstructured Conformation

Typically, the XTEN component of the fusion proteins are designed to behave like denatured peptide sequences under physiological conditions, despite the extended length of the polymer. Denatured describes the state of a peptide in solution that is characterized by a large conformational freedom of the peptide backbone. Most peptides and proteins adopt a denatured conformation in the presence of high concentrations of denaturants or at elevated temperature. Peptides in denatured conformation have, for example, characteristic circular dichroism (CD) spectra and are characterized by a lack of long-range interactions as determined by NMR. "Denatured conformation" and "unstructured conformation" are used synonymously herein. In some cases, the invention provides XTEN sequences that, under physiologic conditions, can resemble denatured sequences largely devoid in secondary structure. In other cases, the XTEN sequences can be substantially devoid of secondary structure under physiologic conditions. "Largely devoid," as used in this context, means that less than 50% of the XTEN amino acid residues of the XTEN sequence contribute to secondary structure as measured or determined by the means described herein. "Substantially devoid," as used in this context, means that at least about 60%, or about 70%, or about 80%, or about 90%, or about 95%, or at least about 99% of the XTEN amino acid residues of the XTEN sequence do not contribute to secondary structure, as measured or determined by the means described herein.

A variety of methods have been established in the art to discern the presence or absence of secondary and tertiary structures in a given polypeptide. In particular, XTEN secondary structure can be measured spectrophotometrically, e.g., by circular dichroism spectroscopy in the "far-UV" spectral region (190-250 nm). Secondary structure elements, such as alpha-helix and beta-sheet, each give rise to a characteristic shape and magnitude of CD spectra. Secondary structure can also be predicted for a polypeptide sequence via certain computer programs or algorithms, such as the well-known Chou-Fasman algorithm (Chou, P. Y., et al. (1974) Biochemistry, 13: 222-45) and the Garnier-Osguthorpe-Robson ("GOR") algorithm (Garnier J, Gibrat J F, Robson B. (1996), GOR method for predicting protein secondary structure from amino acid sequence. Methods Enzymol 266:540-553), as described in US Patent Application Publication No. 20030228309A1. For a given sequence, the algorithms can predict whether there exists some or no secondary structure at all, expressed as the total and/or percentage of residues of the sequence that form, for example, alpha-helices or beta-sheets or the percentage of residues of the sequence predicted to result in random coil formation (which lacks secondary structure).

In some cases, the XTEN sequences used in the inventive fusion protein compositions can have an alpha-helix percentage ranging from 0% to less than about 5% as determined by a Chou-Fasman algorithm. In other cases, the XTEN sequences of the fusion protein compositions can have a beta-sheet percentage ranging from 0% to less than about 5% as determined by a Chou-Fasman algorithm. In some cases, the XTEN sequences of the fusion protein compositions can have an alpha-helix percentage ranging from 0% to less than about 5% and a beta-sheet percentage ranging from 0% to less than about 5% as determined by a Chou-Fasman algorithm. In preferred embodiments, the XTEN sequences of the fusion protein compositions will have an alpha-helix percentage less than about 2% and a beta-sheet percentage less than about 2%. In other cases, the XTEN sequences of the fusion protein compositions can have a high degree of random coil percentage, as determined by a GOR algorithm. In some embodiments, an XTEN sequence can have at least about 80%, more preferably at least about 90%, more preferably at least about 91%, more preferably at least about 92%, more preferably at least about 93%, more preferably at least about 94%, more preferably at least about 95%, more preferably at least about 96%, more preferably at least about 97%, more preferably at least about 98%, and most preferably at least about 99% random coil, as determined by a GOR algorithm.

Net Charge

In other cases, the XTEN polypeptides can have an unstructured characteristic imparted by incorporation of amino acid residues with a net charge and/or reducing the proportion of hydrophobic amino acids in the XTEN sequence. The overall net charge and net charge density may be controlled by modifying the content of charged amino acids in the XTEN sequences. In some cases, the net charge density of the XTEN of the compositions may be above +0.1 or below −0.1 charges/residue. In other cases, the net charge of a XTEN can be about 0%, about 1%, about 2%, about 3%, about 4%, about 5%, about 6%, about 7%, about 8%, about 9%, about 10% about 11%, about 12%, about 13%, about 14%, about 15%, about 16%, about 17%, about 18%, about 19%, or about 20% or more.

Since most tissues and surfaces in a human or animal have a net negative charge, the XTEN sequences can be designed to have a net negative charge to minimize non-specific interactions between the XTEN containing compositions and various surfaces such as blood vessels, healthy tissues, or various receptors. Not to be bound by a particular theory, the XTEN can adopt open conformations due to electrostatic repulsion between individual amino acids of the XTEN polypeptide that individually carry a high net negative charge and that are distributed across the sequence of the XTEN polypeptide. Such a distribution of net negative charge in the extended sequence lengths of XTEN can lead to an unstructured conformation that, in turn, can result in an effective increase in hydrodynamic radius. Accordingly, in one embodiment the invention provides XTEN in which the XTEN sequences contain about 8, 10, 15, 20, 25, or even about 30% glutamic acid. The XTEN of the compositions of the present invention generally have no or a low content of positively charged amino acids. In some cases the XTEN may have less than about 10% amino acid residues with a positive charge, or less than about 7%, or less than about 5%, or less than about 2% amino acid residues with a positive charge. However, the invention contemplates constructs where a limited number of amino acids with a positive charge, such as lysine, may be incorporated into XTEN to permit conjugation between the epsilon amine of the lysine and a reactive group on a peptide, a linker bridge, or a reactive group on a drug or small molecule to be conjugated to the XTEN backbone. In the foregoing, a fusion proteins can be constructed that comprises XTEN, a biologically active protein, plus a chemotherapeutic agent useful in the treatment of metabolic diseases or disorders, wherein the maximum number of molecules of the agent incorporated into the XTEN component is determined by the numbers of lysines or other amino acids with reactive side chains (e.g., cysteine) incorporated into the XTEN.

In some cases, an XTEN sequence may comprise charged residues separated by other residues such as serine or glycine, which may lead to better expression or purification behavior. Based on the net charge, XTENs of the subject compositions may have an isoelectric point (pI) of 1.0, 1.5, 2.0, 2.5, 3.0, 3.5, 4.0, 4.5, 5.0, 5.5, 6.0, or even 6.5. In preferred embodiments, the XTEN will have an isoelectric point between 1.5 and 4.5. In these embodiments, the XTEN incorporated into the BPXTEN fusion protein compositions of the present invention would carry a net negative charge under physiologic conditions that may contribute to the unstructured conformation and reduced binding of the XTEN component to mammalian proteins and tissues.

As hydrophobic amino acids can impart structure to a polypeptide, the invention provides that the content of hydrophobic amino acids in the XTEN will typically be less than 5%, or less than 2%, or less than 10% hydrophobic amino acid content. In one embodiment, the amino acid content of methionine and tryptophan in the XTEN component of a BPXTEN fusion protein is typically less than 5%, or less than 2%, and most preferably less than 1%. In some embodiments, the XTEN will have a sequence that has less than 10% amino acid residues with a positive charge, or less than about 7%, or less that about 5%, or less than about 2% amino acid residues with a positive charge, the sum of methionine and tryptophan residues will be less than 2%, and the sum of asparagine and glutamine residues will be less than 10% of the total XTEN sequence.

Increased Hydrodynamic Radius

In some embodiments, the XTEN can have a high hydrodynamic radius, conferring a corresponding increased Apparent Molecular Weight to the BPXTEN fusion protein which incorporates the XTEN. The linking of XTEN to BP sequences can result in BPXTEN compositions that can have increased hydrodynamic radii, increased Apparent Molecular Weight, and increased Apparent Molecular Weight Factor compared to a BP not linked to an XTEN. For example, in therapeutic applications in which prolonged half-life is desired, compositions in which a XTEN with a high hydrodynamic radius is incorporated into a fusion protein comprising one or more BP can effectively enlarge the hydrodynamic radius of the composition beyond the glomerular pore size of approximately 3-5 nm (corresponding to an apparent molecular weight of about 70 kDa) (Caliceti. 2003. Pharmacokinetic and biodistribution properties of poly(ethylene glycol)-protein conjugates. Adv. Drug Deliv. Rev. 55:1261-1277), resulting in reduced renal clearance of circulating proteins. The hydrodynamic radius of a protein is determined by its molecular weight as well as by its structure, including shape and compactness. Not to be bound by a particular theory, the XTEN can adopt open conformations due to electrostatic repulsion between individual charges of the peptide or the inherent flexibility imparted by the particular amino acids in the sequence that lack potential to confer secondary structure. The open, extended and unstructured conformation of the XTEN polypeptide can have a greater proportional hydrodynamic radius compared to polypeptides of a comparable sequence length and/or molecular weight that have secondary and/or tertiary structure, such as typical globular proteins. Methods for determining the hydrodynamic radius are well known in the art, such as by the use of size exclusion chromatography (SEC), as described in U.S. Pat. Nos. 6,406,632 and 7,294,513. The addition of increasing lengths of XTEN results in proportional increases in the parameters of hydrodynamic radius, Apparent Molecular Weight, and Apparent Molecular Weight Factor, permitting the tailoring of BPXTEN to desired characteristic cut-off Apparent Molecular Weights or hydrodynamic radii. Accordingly, in certain embodiments, the BPXTEN fusion protein can be configured with an XTEN such that the fusion protein can have a hydrodynamic radius of at least about 5 nm, or at least about 8 nm, or at least about 10 nm, or 12 nm, or at least about 15 nm. In the foregoing embodiments, the large hydrodynamic radius conferred by the XTEN in an BPXTEN fusion protein can lead to reduced renal clearance of the resulting fusion protein, leading to a corresponding increase in terminal half-life, an increase in mean residence time, and/or a decrease in renal clearance rate.

In some embodiments, an XTEN of a chosen length and sequence can be selectively incorporated into a BPXTEN to create a fusion protein that will have, under physiologic conditions, an Apparent Molecular Weight of at least about 150 kDa, or at least about 300 kDa, or at least about 400 kDa, or at least about 500 kDa, or at least about 600 kDa, or at least about 700 kDa, or at least about 800 kDa, or at least about 900 kDa, or at least about 1000 kDa, or at least about 1200 kDa, or at least about 1500 kDa, or at least about 1800 kDa, or at least about 2000 kDa, or at least about 2300 kDa or more. In some embodiments, an XTEN of a chosen length and sequence can be selectively linked to a BP to result in a BPXTEN fusion protein that has, under physiologic conditions, an Apparent Molecular Weight Factor of at least three, alternatively of at least four, alternatively of at least five, alternatively of at least six, alternatively of at least seven, alternatively of at least eight, alternatively of at least nine, alternatively of at least 10, alternatively of at least 15, or an Apparent Molecular Weight Factor of at least 20 or greater. In some embodiments, the BPXTEN fusion protein has, under physiologic conditions, an Apparent Molecular Weight Factor that is about 4 to about 20, or is about 6 to about 15, or is about 8 to about 12, or is about 9 to about 10 relative to the actual molecular weight of the fusion protein. In some embodiments, the (fusion) polypeptide exhibits an apparent molecular weight factor under physiological conditions that is greater than about 6.

Increased Terminal Half-Life

In some embodiments, the (fusion) polypeptide has a terminal half-life that is at least two-fold longer, or at least three-fold longer, or at least four-fold longer, or at least five-fold longer, compared to the biologically active polypeptide not linked to any XTEN. In some embodiments, the (fusion) polypeptide has a terminal half-life that is at least two-fold longer compared to the biologically active polypeptide not linked to any XTEN.

Administration of a therapeutically effective dose of any of the embodiments of BPXTEN fusion proteins described herein to a subject in need thereof can result in a gain in time of at least two-fold, or at least three-fold, or at least four-fold, or at least five-fold or more spent within a therapeutic window for the fusion protein compared to the corresponding BP not linked to the XTEN of and administered at a comparable dose to a subject.

Low Immunogenicity

In some embodiments, the invention provides compositions in which the XTEN sequences have a low degree of immunogenicity or are substantially non-immunogenic. Several factors can contribute to the low immunogenicity of XTEN, e.g., the substantially non-repetitive sequence, the unstructured conformation, the high degree of solubility, the low degree or lack of self-aggregation, the low degree or lack of proteolytic sites within the sequence, and the low degree or lack of epitopes in the XTEN sequence.

One of ordinary skill in the art will understand that, in general, a polypeptide having highly repetitive short amino acid sequences (e.g., wherein a 200 amino acid-long sequence contain on average 20 repeats or more of a limited set of 3- or 4-mers) and/or having contiguous repetitive amino acid residues (e.g., wherein 5- or 6-mer sequences have identical amino acid residues) have a tendency to aggregate or form higher order structures or form contacts resulting in crystalline or pseudo-crystalline structures.

In some embodiments, the XTEN sequence is substantially non-repetitive, wherein (1) the XTEN sequence has no three contiguous amino acids that are identical amino acid types, unless the amino acid is serine, in which case no more than three contiguous amino acids can be serine residues; and wherein (2) the XTEN contains no 3-amino acid sequences (3-mers) that occur more than 16, more than 14, more than 12, or more than 10 times within a 200 amino acid-long sequence of the XTEN. One of ordinary skill in the art will understand that such substantially non-repetitive sequences have less tendency to aggregate and, thus, enable the design of long-sequence XTENs with a relatively low frequency of charged amino acids that would be likely to aggregate if the sequences or amino acid residues were otherwise more repetitive.

Conformational epitopes are formed by regions of the protein surface that are composed of multiple discontinuous amino acid sequences of the protein antigen. The precise folding of the protein brings these sequences into a well-defined, stable spatial configurations, or epitopes, that can be recognized as "foreign" by the host humoral immune system, resulting in the production of antibodies to the protein or triggering a cell-mediated immune response. In the latter case, the immune response to a protein in an individual is heavily influenced by T-cell epitope recognition that is a function of the peptide binding specificity of that individual's HLA-DR allotype. Engagement of an MHC Class II peptide complex by a cognate T-cell receptor on the surface of the T-cell, together with the cross-binding of certain other co-receptors such as the CD4 molecule, can induce an activated state within the T-cell. Activation leads to the release of cytokines further activating other lymphocytes such as B cells to produce antibodies or activating T killer cells as a full cellular immune response.

The ability of a peptide to bind a given MHC Class II molecule for presentation on the surface of an APC (antigen presenting cell) is dependent on a number of factors; most notably its primary sequence. In one embodiment, a lower degree of immunogenicity may be achieved by designing XTEN sequences that resist antigen processing in antigen presenting cells, and/or choosing sequences that do not bind MHC receptors well. The invention provides BPXTEN fusion proteins with substantially non-repetitive XTEN polypeptides designed to reduce binding with MHC II receptors, as well as avoiding formation of epitopes for T-cell receptor or antibody binding, resulting in a low degree of immunogenicity. Avoidance of immunogenicity is, in part, a direct result of the conformational flexibility of XTEN sequences; i.e., the lack of secondary structure due to the selection and order of amino acid residues. For example, of particular interest are sequences having a low tendency to adapt compactly folded conformations in aqueous solution or under physiologic conditions that could result in conformational epitopes. The administration of fusion proteins comprising XTEN, using conventional therapeutic practices and dosing, would generally not result in the formation of neutralizing antibodies to the XTEN sequence, and may also reduce the immunogenicity of the BP fusion partner in the BPXTEN compositions.

In one embodiment, the XTEN sequences utilized in the subject fusion proteins can be substantially free of epitopes recognized by human T cells. The elimination of such epitopes for the purpose of generating less immunogenic proteins has been disclosed previously; see for example WO 98/52976, WO 02/079232, and WO 00/3317 which are incorporated by reference herein. Assays for human T cell epitopes have been described (Stickler, M., et al. (2003) *J Immunol Methods,* 281: 95-108). Of particular interest are peptide sequences that can be oligomerized without generating T cell epitopes or non-human sequences. This can be achieved by testing direct repeats of these sequences for the presence of T-cell epitopes and for the occurrence of 6 to 15-mer and, in particular, 9-mer sequences that are not human, and then altering the design of the XTEN sequence to eliminate or disrupt the epitope sequence. In some cases, the XTEN sequences are substantially non-immunogenic by the restriction of the numbers of epitopes of the XTEN predicted to bind MHC receptors. With a reduction in the numbers of epitopes capable of binding to MHC receptors, there is a concomitant reduction in the potential for T cell activation as well as T cell helper function, reduced B cell activation or upregulation and reduced antibody production. The low degree of predicted T-cell epitopes can be determined by epitope prediction algorithms such as, e.g., TEPITOPE (Sturniolo, T., et al. (1999) Nat Biotechnol, 17: 555-61), as shown in Example 74 of International Patent Application Publication No. WO 2010/144502 A2, which is incorporated by reference in its entirety. The TEPITOPE score of a given peptide frame within a protein is the log of the $K_d$ (dissociation constant, affinity, off-rate) of the binding of that peptide frame to multiple of the most common human MHC alleles, as disclosed in Sturniolo, T. et al. (1999) *Nature Biotechnology* 17:555). The score ranges over at least 20 logs, from about 10 to about −10 (corresponding to binding constraints of $10e^{10}$ $K_d$ to $10e^{-10}$ KA), and can be reduced by avoiding hydrophobic amino acids that can serve as anchor residues during peptide display on MHC, such as M, I, L, V, or F. In some embodiments, an XTEN component incorporated into a BPXTEN does not have a predicted T-cell epitope at a TEPITOPE score of about −5 or greater, or −6 or greater, or −7 or greater, or −8 or greater, or at a TEPITOPE score of −9 or greater. As used herein, a score of "−9 or greater" would encompass TEPITOPE scores of 10 to −9, inclusive, but would not encompass a score of −10, as −10 is less than −9.

In some embodiments, the inventive XTEN sequences, including those incorporated into the subject BPXTEN fusion proteins, can be rendered substantially non-immunogenic by the restriction of known proteolytic sites from the sequence of the XTEN, reducing the processing of XTEN into small peptides that can bind to MHC II receptors. In some embodiments, the XTEN sequence can be rendered substantially non-immunogenic by the use a sequence that is substantially devoid of secondary structure, conferring resistance to many proteases due to the high entropy of the structure. Accordingly, the reduced TEPITOPE score and elimination of known proteolytic sites from the XTEN may render the XTEN compositions, including the XTEN of the BPXTEN fusion protein compositions, substantially unable to be bound by mammalian receptors, including those of the immune system. In one embodiment, an XTEN of a BPXTEN fusion protein can have >100 nM $K_d$ binding to a mammalian receptor, or greater than 500 nM $K_d$, or greater than 1 pM $K_d$ towards a mammalian cell surface or circulating polypeptide receptor.

Additionally, the substantially non-repetitive sequence and corresponding lack of epitopes of such embodiments of XTEN can limit the ability of B cells to bind to or be activated by XTEN. While an XTEN can make contacts with many different B cells over its extended sequence, each individual B cell may only make one or a small number of contacts with an individual XTEN. As a result, XTENs typically may have a much lower tendency to stimulate proliferation of B cells and thus an immune response. In one embodiment, the BPXTEN may have reduced immunogenicity as compared to the corresponding BP that is not fused. In one embodiment, the administration of up to three parenteral doses of a BPXTEN to a mammal may result in detectable anti-BPXTEN IgG at a serum dilution of 1:100 but not at a dilution of 1:1000. In some embodiments, the administration of up to three parenteral doses of an BPXTEN to a mammal may result in detectable anti-BP IgG at a serum dilution of 1:100 but not at a dilution of 1:1000. In some embodiments, the administration of up to three parenteral doses of an BPXTEN to a mammal may result in detectable anti-XTEN IgG at a serum dilution of 1:100 but not at a dilution of 1:1000. In the foregoing embodiments, the mammal can be a mouse, a rat, a rabbit, or a cynomolgus monkey.

An additional feature of certain embodiments of XTENs with substantially non-repetitive sequences relative to those less non-repetitive sequences (such as one having three contiguous amino acids that are identical) can be that non-repetitive XTENs form weaker contacts with antibodies (e.g. monovalent interactions), thereby resulting in less likelihood of immune clearance such that the BPXTEN compositions can remain in circulation for an increased period of time.

In some embodiments, the (fusion) polypeptide is less immunogenic compared to the biologically active polypeptide not linked to any XTEN, wherein immunogenicity is ascertained by measuring production of IgG antibodies that selectively bind to the biologically active polypeptide after administration of comparable doses to a subject.

Spacers & BP Release Segment

In some embodiments, at least a portion of the biological activity of the respective BP is retained by the intact BPXTEN. In some embodiments, the BP component either becomes biologically active or has an increase in biological activity upon its release from the XTEN by cleavage of an optional cleavage sequence incorporated within spacer sequences into the BPXTEN, as described more fully hereinbelow.

Any spacer sequence group is optional in the fusion proteins encompassed by the invention. The spacer may be provided to enhance expression of the fusion protein from a host cell or to decrease steric hindrance such that the BP component may assume its desired tertiary structure and/or interact appropriately with its target molecule. For spacers and methods of identifying desirable spacers, see, for example, George, et al. (2003) Protein Engineering 15:871-879, specifically incorporated by reference herein. In one embodiment, the spacer comprises one or more peptide sequences that are between 1 to 50 amino acid residues in length, or about 1 to 25 residues, or about 1 to 10 residues in length. Spacer sequences, exclusive of cleavage sites, can comprise any of the 20 natural L amino acids, and will preferably comprise hydrophilic amino acids that are sterically unhindered that can include, but not be limited to, glycine (G), alanine (A), serine (S), threonine (T), glutamate (E) or proline (P). In some embodiments, the spacer can be polyglycines or polyalanines, or predominately a mixture of combinations of glycine and alanine residues. The spacer polypeptide exclusive of a cleavage sequence is largely to substantially devoid of secondary structure. In one embodiment, one or both spacer sequences in a BPXTEN fusion protein composition may each further contain a cleavage sequence, which may be identical or may be different, wherein the cleavage sequence may be acted on by a protease to release the BP from the fusion protein.

In some cases, the incorporation of the cleavage sequence into the BPXTEN is designed to permit release of a BP that becomes active or more active upon its release from the XTEN. The cleavage sequences are located sufficiently close to the BP sequences, generally within 18, or within 12, or within 6, or within 2 amino acids of the BP sequence terminus, such that any remaining residues attached to the BP after cleavage do not appreciably interfere with the activity (e.g., such as binding to a receptor) of the BP, yet provide sufficient access to the protease to be able to effect cleavage of the cleavage sequence. In some embodiments, the cleavage site is a sequence that can be cleaved by a protease endogenous to the mammalian subject such that the BPXTEN can be cleaved after administration to a subject. In such cases, the BPXTEN can serve as a prodrug or a circulating depot for the BP. Examples of cleavage sites contemplated by the invention include, but are not limited to, a polypeptide sequence cleavable by a mammalian endogenous protease that is FXIa, FXIIa, kallikrein, FVIIa, FIXa, FXa, FIIa (thrombin), Elastase-2, granzyme B, MMP-12, MMP-13, MMP-17 or MMP-20, or by non-mammalian proteases such as TEV, enterokinase, PreScission™ protease (rhinovirus 3C protease), or sortase A. Sequences known to be cleaved by the foregoing proteases are known in the art. Exemplary cleavage sequences and cut sites within the sequences are presented in Table 7a, as well as sequence variants. For example, thrombin (activated clotting factor II) acts on the sequence LTPRSLLV (SEQ ID NO: 222) [Rawlings N. D., et al. (2008) Nucleic Acids Res., 36: D320], which would be cut after the arginine at position 4 in the sequence. Active FIIa is produced by cleavage of FII by FXa in the presence of phospholipids and calcium and is downstream from factor IX in the coagulation pathway. Once activated its natural role in coagulation is to cleave fibrinogen, which then in turn, begins clot formation. FIIa activity is tightly controlled and only occurs when coagulation is necessary for proper hemostasis. However, as coagulation is an on-going process in mammals, by incorporation of the LTPRSLLV (SEQ ID NO: 222) sequence into the BPXTEN between the BP and the XTEN, the XTEN domain would be removed from the adjoining BP concurrent with activation of either the extrinsic or intrinsic coagulation pathways when coagulation is required physiologically, thereby releasing BP over time. Similarly, incorporation of other sequences into BPXTEN that are acted upon by endogenous proteases would provide for sustained release of BP that may, in certain cases, provide a higher degree of activity for the BP from the "prodrug" form of the BPXTEN.

In some cases, only the two or three amino acids flanking both sides of the cut site (four to six amino acids total) would be incorporated into the cleavage sequence. In other cases, the known cleavage sequence can have one or more deletions or insertions or one or two or three amino acid substitutions for any one or two or three amino acids in the known sequence, wherein the deletions, insertions or substitutions result in reduced or enhanced susceptibility but not an absence of susceptibility to the protease, resulting in an ability to tailor the rate of release of the BP from the XTEN. Exemplary substitutions are shown in Table 7a.

In some embodiments, the BPXTEN fusion protein can comprise spacer sequences that can further comprise one or more cleavage sequences configured to release the BP from the fusion protein when acted on by a protease. In some embodiments, the one or more cleavage sequences can be a sequence having at least about 80% (e.g., at least about 85%, at least about 90%, at least about 95%, at least about 96%, at least about 97%, at least about 98%, at least about 99%, or 100%) sequence identify to a sequence from Table 7a.

In some embodiments, the disclosure provides BP release segment peptides (or release segment (RS)) that are substrates for one or more mammalian proteases associated with or produced by disease tissues or cells found in proximity to disease tissues. Such proteases can include, but not be limited to, the classes of proteases such as metalloproteinases, cysteine proteases, aspartate proteases, and serine proteases, including, but not limited to, the proteases of Table 7b. The RS are useful for, amongst other things, incorporation into the subject recombinant polypeptides, conferring a prodrug format that can be activated by the cleavage of the RS by mammalian proteases. As described herein, the RS are incorporated into the subject recombinant polypeptide compositions, linking the incorporated binding moieties to the XTEN (the configurations of which are TABLE 7a Protease Cleavage Sequences for BP Release

| Protease Acting Upon Sequence | SEQ ID NO | Exemplary Cleavage Sequence | SEQ ID NO | Minimal Cut Site* |
|---|---|---|---|---|
| FXIa | 224 | KLTR↓VVGG | 244 | KD/FL/T/R↓VA/VE/GT/GV |
| FXIIa | 225 | TMTR↓IVGG | NA | NA |
| Kallikrein | 226 | SPFR↓STGG | 245 | -/-/FL/RY↓SR/RT/-/- |
| FVIIa | 227 | LQVR↓IVGG | NA | NA |
| FIXa | 228 | PLGR↓IVGG | 247 | -/-/G/R↓-/-/-/- |
| FXa | 229 | IEGR↓TVGG | 248 | IA/E/GFP/R↓STI/VFS/-/G |
| FIIa (thrombin) | 230 | LTPR↓SLLV | 249 | -/-/PLA/R↓SAG/-/-/- |
| Elastase-2 | 231 | LGPV↓SGVP | 250 | -/-/-/VIAT↓-/-/-/- |
| Granzyme-B | 232 | VAGD↓SLEE | 251 | V/-/-/D↓-/-/-/- |
| MMP-12 | 233 | GPAG↓LGGA | 241 | G/PA/-/G↓L/-/G/- (SEQ ID NO: 241) |
| MMP-13 | 234 | GPAG↓LRGA | 242 | G/P/-/G↓L/-/GA/- (SEQ ID NO: 242) |
| MMP-17 | 235 | APLG↓LRLR | 252 | -/PS/-/-↓LQ/-/LT/- |
| MMP-20 | 236 | PALP↓LVAQ | NA | NA |
| TEV | 237 | ENLYFQ↓G | 243 | ENLYFQ↓/GS |
| Enterokinase | 238 | DDDK↓IVGG | 238 | DDDK↓IVGG |
| Protease 3C (PreScission ™) | 239 | LEVLFQ↓GP | 239 | LEVLFQ↓GP |
| Sortase A | 240 | LPKT↓GSES | 246 | L/P/KEAD/T↓G/-/EKS/S |

↓indicates cleavage site;
NA: not applicable;
*the listing of multiple amino acids before, between, or after a slash indicate alternative amino acids that can be substituted at the position;
"-" indicates that any amino acid may be substituted for the corresponding amino acid indicated in the middle column described more fully, below) such that upon cleavage of the RS by action of the one or more proteases for which the RS are substrates, the binding moieties and XTEN are released from the composition and the binding moieties, no longer shielded by the XTEN, regain their full potential to bind their ligands. In those recombinant polypeptide compositions comprising a first and a second antibody fragment, the compositions are also referred to herein as activatable antibody compositions (AAC).

TABLE 7b

| Proteases of Target Tissues | |
| --- | --- |
| Class of Proteases | Protease |
| Metalloproteinases | Meprin |
| | Neprilysin (CD10) |
| | PSMA |
| | BMP-1 |
| | A disintegrin and metalloproteinases (ADAMs) |
| | ADAM8 |
| | ADAM9 |
| | ADAM10 |
| | ADAM12 |
| | ADAM15 |
| | ADAM17 (TACE) |
| | ADAM19 |
| | ADAM28 (MDC-L) |
| | ADAM with thrombospondin motifs (ADAMTS) |
| | ADAMTS1 |
| | ADAMTS4 |
| | ADAMTS5 |
| | Matrix Metalloproteinases (MMPs) |
| | MMP-1 (Collagenase 1) |
| | MMP-2 (Gelatinase A) |
| | MMP-3 (m1) |
| | MMP-7 (Matrilysin 1) |
| | MMP-8 (Collagenase 2) |
| | MMP-9 (Gelatinase B) |
| | MMP-10 (Stromelysin 2) |
| | MMP-11(Stromelysin 3) |
| | MMP-12 (Macrophage elastase) |
| | MMP-13 (Collagenase 3) |
| | MMP-14 (MT1-MMP) |
| | MMP-15 (MT2-MMP) |
| | MMP-19 |
| | MMP-23 (CA-MMP) |
| | MMP-24 (MT5-MMP) |
| | MMP-26 (Matrilysin 2) |
| | MMP-27 (CMMP) |
| Cysteine Proteases | Legumain |
| | Cysteine cathepsins |
| | Cathepsin B |
| | Cathepsin C |
| | Cathepsin K |
| | Cathepsin L |
| | Cathepsin S |
| | Cathepsin X |
| Aspartate Proteases | Cathepsin D |
| | Cathepsin E |
| | Secretase |
| Serine Proteases | Urokinase (uPA) |
| | Tissue-type plasminogen activator (tPA) |
| | Plasmin |
| | Thrombin |
| | Prostate-specific antigen (PSA, KLK3) |
| | Human neutrophil elastase (HNE) |
| | Elastase |
| | Tryptase |
| | Type II transmembrane serine proteases (TTSPs) |
| | DESC1 |
| | Hepsin (HPN) |
| | Matriptase |
| | Matriptase-2 |
| | TMPRSS2 |
| | TMPRSS3 |
| | TMPRSS4 (CAP2) |
| | Fibroblast Activation Protein (FAP) |
| | kallikrein-related peptidase (KLK family) |

TABLE 7b-continued

| Proteases of Target Tissues | |
| --- | --- |
| Class of Proteases | Protease |
| | KLK4 |
| | KLK5 |
| | KLK6 |
| | KLK7 |
| | KLK8 |
| | KLK10 |
| | KLK11 |
| | KLK13 |
| | KLK14 |

In one embodiment, the disclosure provides activatable recombinant polypeptides comprising a first release segment (RS1) sequence having at least 88%, or at least 94%, or 10000 sequence identity, when optimally aligned, to a sequence identified herein by the sequences set forth in Table 8a, wherein the RS1 is a substrate for one or more mammalian proteases. In other embodiments, the disclosure provides activatable recombinant polypeptides comprising a RS1 and a second release segment (RS2) sequence, each having at least 88%, or at least 94%, or 100% sequence identity, when optimally aligned, to a sequence identified herein by the sequences set forth in Table 8a, wherein the RS1 and the RS2 each are a substrate for one or more mammalian proteases. In some embodiments, disclosure provides activatable recombinant polypeptides comprising a first RS (RS1) sequence having at least 90%, at least 93%, at least 97%, or 100% identity, when optimally aligned, to a sequence identified herein by the sequences set forth in Table 8b, wherein the RS is a substrate for one or more mammalian proteases. In other embodiments, the disclosure provides activatable recombinant polypeptides comprising a RS1 and a second release segment (RS2) sequence, each having at least 88%, or at least 94%, or 100% sequence identity, when optimally aligned, to a sequence identified herein by the sequences set forth in Table 8b, wherein the RS1 and the RS2 are each a substrate for one or more mammalian proteases (e.g., at one, two, or three cleavage sites within each release segment sequence). In the embodiments of activatable recombinant polypeptides comprising RS1 and RS2, the two release segments can be identical or the sequences can be different.

The present disclosure contemplates release segments that are substrates for one, two or three different classes of proteases that are metalloproteinases, cysteine proteases, aspartate proteases, or seine proteases, including the proteases of Table 7b. In a particular feature, the RS serve as substrates for proteases found in close association with or are co-localized with disease tissues or cells, such as but not limited to tumors, cancer cells, and inflammatory tissues, and upon cleavage of the RS, the binding moieties that are otherwise shielded by the XTEN of the subject recombinant polypeptide compositions (and thus have a lower binding affinity for their respective ligands) are released from the composition and regain their full potential to bind the target and/or effector cell ligands. In some embodiments, the RS of the subject recombinant polypeptide compositions comprises an amino acid sequence that is a substrate for a cellular protease located within a targeted cell, including but not limited to the proteases of Table 7b. In another particular feature of the subject recombinant polypeptide compositions, the RS that are substrates for two or three classes of proteases were designed with sequences that are capable of being cleaved in different locations of the RS sequence by the different proteases. Thus, the RS that are substrates for two, three, or more classes of proteases have two, three, or a plurality of distinct cleavage sites in the RS sequence, but cleavage by a single protease nevertheless results in the release of the binding moieties and the XTEN from the recombinant polypeptide composition comprising the RS.

In one embodiment, the RS of the disclosure for incorporation into the subject recombinant polypeptide compositions is a substrate for one or more proteases including but not limited to meprin, neprilysin (CD10), PSMA, BMP-1, A disintegrin and metalloproteinases (ADAMs), ADAM8, ADAM9, ADAM10, ADAM12, ADAM15, ADAM17 (TACE), ADAM19, ADAM28 (MDC-L), ADAM with thrombospondin motifs (ADAMTS), ADAMTS1, ADAMTS4, ADAMTS5, MMP-1 (collagenase 1), matrix metalloproteinase-1 (MMP-1), matrix metalloproteinase-2 (MMP-2, gelatinase A), matrix metalloproteinase-3 (MMP-3, stromelysin 1), matrix metalloproteinase-7 (MMP-7, Matrilysin 1), matrix metalloproteinase-8 (MMP-8, collagenase 2), matrix metalloproteinase-9 (MMP-9, gelatinase B), matrix metalloproteinase-10 (MMP-10, stromelysin 2), matrix metalloproteinase-11 (MMP-11, stromelysin 3), matrix metalloproteinase-12 (MMP-12, macrophage elastase), matrix metalloproteinase-13 (MMP-13, collagenase 3), matrix metalloproteinase-14 (MMP-14, MT1-MMP), matrix metalloproteinase-15 (MMP-15, MT2-MMP), matrix metalloproteinase-19 (MMP-19), matrix metalloproteinase-23 (MMP-23, CA-MMP), matrix metalloproteinase-24 (MMP-24, MT5-MMP), matrix metalloproteinase-26 (MMP-26, matrilysin 2), matrix metalloproteinase-27 (MMP-27, CMMP), legumain, cathepsin B, cathepsin C, cathepsin K, cathepsin L, cathepsin S, cathepsin X, cathepsin D, cathepsin E, secretase, urokinase (uPA), tissue-type plasminogen activator (tPA), plasmin, thrombin, prostate-specific antigen (PSA, KLK3), human neutrophil elastase (HNE), elastase, tryptase, Type II transmembrane serine proteases (TTSPs), DESC1, hepsin (HPN), matriptase, matriptase-2, TMPRSS2, TMPRSS3, TMPRSS4 (CAP2), fibroblast activation protein (FAP), kallikrein-related peptidase (KLK family), KLK4, KLK5, KLK6, KLK7, KLK8, KLK10, KLK11, KLK13, and KLK14. In one embodiment, the RS is a substrate for ADAM17. In one embodiment, the RS is a substrate for BMP-1. In one embodiment, the RS is a substrate for cathepsin. In one embodiment, the RS is a substrate for HtrA1. In one embodiment, the RS is a substrate for legumain. In one embodiment, the RS is a substrate for MMP-1. In one embodiment, the RS is a substrate for MMP-2. In one embodiment, the RS is a substrate for MMP-7. In one embodiment, the RS is a substrate for MMP-9. In one embodiment, the RS is a substrate for MMP-11. In one embodiment, the RS is a substrate for MMP-14. In one embodiment, the RS is a substrate for uPA. In one embodiment, the RS is a substrate for matriptase. In one embodiment, the RS is a substrate for MT-SP 1. In one embodiment, the RS is a substrate for neutrophil elastase. In one embodiment, the RS is a substrate for thrombin. In one embodiment RS is a substrate for TMPRSS3. In one embodiment, the RS is a substrate for TMPRSS4. In one embodiment, the RS of the subject recombinant polypeptide compositions is a substrate for at least two proteases including but not limited to legumain, MMP-1, MMP-2, MMP-7, MMP-9, MMP-11, MMP-14, uPA, and matriptase. In some embodiments, the RS of the subject recombinant polypeptide compositions is a substrate for legumain, MMP-1, MMP-2, MMP-7, MMP-9, MMP-11, MMP-14, uPA, and matriptase.

TABLE 8a

BP Release Segment Sequences.

| Name | Construct ID | Amino Acid Sequence | SEQ ID NO |
|---|---|---|---|
| RSR-1517 | AC1611 | EAGRSANHEPLGLVAT | 7001 |
| BSRS-A1-1 | AC1605 | ASGRSTNAGPSGLAGP | 7002 |
| BSRS-A2-1 | AC1606 | ASGRSTNAGPQGLAGQ | 7003 |
| BSRS-A3-1 | AC1607 | ASGRSTNAGPPGLTGP | 7004 |
| VP-1 | AC1608 | ASSRGTNAGPAGLTGP | 7005 |
| RSR-1752 | AC1609 | ASSRTTNTGPSTLTGP | 7006 |
| RSR-1512 | AC1610 | AAGRSDNGTPLELVAP | 7007 |
| RSR-1517 | AC1611 | EAGRSANHEPLGLVAT | 7008 |
| VP-2 | AC1612 | ASGRGTNAGPAGLTGP | 7009 |
| RSR-1018 | AC1613 | LFGRNDNHEPLELGGG | 7010 |
| RSR-1053 | AC1614 | TAGRSDNLEPLGLVFG | 7011 |
| RSR-1059 | AC1615 | LDGRSDNFHPPELVAG | 7012 |
| RSR-1065 | AC1616 | LEGRSDNEEPENLVAG | 7013 |
| RSR-1167 | AC1617 | LKGRSDNNAPLALVAG | 7014 |
| RSR-1201 | AC1618 | VYSRGTNAGPHGLTGR | 7015 |
| RSR-1218 | AC1619 | ANSRGTNKGFAGLIGP | 7016 |
| RSR-1226 | AC1620 | ASSRLTNEAPAGLTIP | 7017 |
| RSR-1254 | AC1621 | DQSRGTNAGPEGLTDP | 7018 |
| RSR-1256 | AC1622 | ESSRGTNIGQGGLTGP | 7019 |
| RSR-1261 | AC1623 | SSSRGTNQDPAGLTIP | 7020 |
| RSR-1293 | AC1624 | ASSRGQNHSPMGLTGP | 7021 |
| RSR-1309 | AC1625 | AYSRGPNAGPAGLEGR | 7022 |
| RSR-1326 | AC1626 | ASERGNNAGPANLTGF | 7023 |
| RSR-1345 | AC1627 | ASHRGTNPKPAILTGP | 7024 |
| RSR-1354 | AC1628 | MSSRRTNANPAQLTGP | 7025 |
| RSR-1426 | AC1629 | GAGRTDNHEPLELGAA | 7026 |
| RSR-1478 | AC1630 | LAGRSENTAPLELTAG | 7027 |
| RSR-1479 | AC1631 | LEGRPDNHEPLALVAS | 7028 |
| RSR-1496 | AC1632 | LSGRSDNEEPLALPAG | 7029 |
| RSR-1508 | AC1633 | EAGRTDNHEPLELSAP | 7030 |
| RSR-1513 | AC1634 | EGGRSDNHGPLELVSG | 7031 |
| RSR-1516 | AC1635 | LSGRSDNEAPLELEAG | 7032 |
| RSR-1524 | AC1636 | LGGRADNHEPPELGAG | 7033 |
| RSR-1622 | AC1637 | PPSRGTNAEPAGLTGE | 7034 |
| RSR-1629 | AC1638 | ASTRGENAGPAGLEAP | 7035 |
| RSR-1664 | AC1639 | ESSRGTNGAPEGLTGP | 7036 |
| RSR-1667 | AC1640 | ASSRATNESPAGLTGE | 7037 |
| RSR-1709 | AC1641 | ASSRGENPPPGGLTGP | 7038 |

TABLE 8a-continued

BP Release Segment Sequences.

| Name | Construct ID | Amino Acid Sequence | SEQ ID NO |
|---|---|---|---|
| RSR-1712 | AC1642 | AASRGTNTGPAELTGS | 7039 |
| RSR-1727 | AC1643 | AGSRTTNAGPGGLEGP | 7040 |
| RSR-1754 | AC1644 | APSRGENAGPATLTGA | 7041 |
| RSR-1819 | AC1645 | ESGRAANTGPPTLTAP | 7042 |
| RSR-1832 | AC1646 | NPGRAANEGPPGLPGS | 7043 |
| RSR-1855 | AC1647 | ESSRAANLTPPELTGP | 7044 |
| RSR-1911 | AC1648 | ASGRAANETPPGLTGA | 7045 |
| RSR-1929 | AC1649 | NSGRGENLGAPGLTGT | 7046 |
| RSR-1951 | AC1650 | TTGRAANLTPAGLTGP | 7047 |
| RSR-2295 | AC1761 | EAGRSANHTPAGLTGP | 7048 |
| RSR-2298 | AC1762 | ESGRAANTTPAGLTGP | 7049 |
| RSR-2038 | AC1679 | TTGRATEAANLTPAGLTGP | 7050 |
| RSR-2072 | AC1680 | TTGRAEEAANLTPAGLTGP | 7051 |
| RSR-2089 | AC1681 | TTGRAGEAANLTPAGLTGP | 7052 |
| RSR-2302 | AC1682 | TTGRATEAANATPAGLTGP | 7053 |
| RSR-3047 | AC1697 | TTGRAGEAEGATSAGATGP | 7054 |
| RSR-3052 | AC1698 | TTGEAGEAANATSAGATGP | 7055 |
| RSR-3043 | AC1699 | TTGEAGEAAGLTPAGLTGP | 7056 |
| RSR-3041 | AC1700 | TTGAAGEAANATPAGLTGP | 7057 |
| RSR-3044 | AC1701 | TTGRAGEAAGLTPAGLTGP | 7058 |
| RSR-3057 | AC1702 | TTGRAGEAANATSAGATGP | 7059 |
| RSR-3058 | AC1703 | TTGEAGEAAGATSAGATGP | 7060 |
| RSR-2485 | AC1763 | ESGRAANTEPPELGAG | 7061 |
| RSR-2486 | AC1764 | ESGRAANTAPEGLTGP | 7062 |
| RSR-2488 | AC1688 | EPGRAANHEPSGLTEG | 7063 |
| RSR-2599 | AC1706 | ESGRAANHTGAPPGGLTGP | 7064 |
| RSR-2706 | AC1716 | TTGRTGEGANATPGGLTGP | 7065 |
| RSR-2707 | AC1717 | RTGRSGEAANETPEGLEGP | 7066 |
| RSR-2708 | AC1718 | RTGRTGESANETPAGLGGP | 7067 |
| RSR-2709 | AC1719 | STGRTGEPANETPAGLSGP | 7068 |
| RSR-2710 | AC1720 | TTGRAGEPANATPTGLSGP | 7069 |
| RSR-2711 | AC1721 | RTGRPGEGANATPTGLPGP | 7070 |
| RSR-2712 | AC1722 | RTGRGGEAANATPSGLGGP | 7071 |
| RSR-2713 | AC1723 | STGRSGESANATPGGLGGP | 7072 |
| RSR-2714 | AC1724 | RTGRTGEEANATPAGLPGP | 7073 |
| RSR-2715 | AC1725 | ATGRPGEPANTTPEGLEGP | 7074 |
| RSR-2716 | AC1726 | STGRSGEPANATPGGLTGP | 7075 |
| RSR-2717 | AC1727 | PTGRGGEGANTTPTGLPGP | 7076 |
| RSR-2718 | AC1728 | PTGRSGEGANATPSGLTGP | 7077 |
| RSR-2719 | AC1729 | TTGRASEGANSTPAPLTEP | 7078 |
| RSR-2720 | AC1730 | TYGRAAEAANTTPAGLTAP | 7079 |
| RSR-2721 | AC1731 | TTGRATEGANATPAELTEP | 7080 |
| RSR-2722 | AC1732 | TVGRASEEANTTPASLTGP | 7081 |
| RSR-2723 | AC1733 | TTGRAPEAANATPAPLTGP | 7082 |
| RSR-2724 | AC1734 | TWGRATEPANATPAPLTSP | 7083 |
| RSR-2725 | AC1735 | TVGRASESANATPAELTSP | 7084 |
| RSR-2726 | AC1736 | TVGRAPEGANSTPAGLTGP | 7085 |
| RSR-2727 | AC1737 | TWGRATEAPNLEPATLTTP | 7086 |
| RSR-2728 | AC1738 | TTGRATEAPNLTPAPLTEP | 7087 |
| RSR-2729 | AC1739 | TQGRATEAPNLSPAALTSP | 7088 |
| RSR-2730 | AC1740 | TQGRAAEAPNLTPATLTAP | 7089 |
| RSR-2731 | AC1741 | TSGRAPEATNLAPAPLTGP | 7090 |
| RSR-2732 | AC1742 | TQGRAAEAANLTPAGLTEP | 7091 |
| RSR-2733 | AC1743 | TTGRAGSAPNLPPTGLTTP | 7092 |
| RSR-2734 | AC1744 | TTGRAGGAENLPPEGLTAP | 7093 |
| RSR-2735 | AC1745 | TTSRAGTATNLTPEGLTAP | 7094 |
| RSR-2736 | AC1746 | TTGRAGTATNLPPSGLTTP | 7095 |
| RSR-2737 | AC1747 | TTARAGEAENLSPSGLTAP | 7096 |
| RSR-2738 | AC1748 | TTGRAGGAGNLAPGGLTEP | 7097 |
| RSR-2739 | AC1749 | TTGRAGTATNLPPEGLTGP | 7098 |
| RSR-2740 | AC1750 | TTGRAGGAANLAPTGLTEP | 7099 |
| RSR-2741 | AC1751 | TTGRAGTAENLAPSGLTTP | 7100 |
| RSR-2742 | AC1752 | TTGRAGSATNLGPGGLTGP | 7101 |
| RSR-2743 | AC1753 | TTARAGGAENLTPAGLTEP | 7102 |
| RSR-2744 | AC1754 | TTARAGSAENLSPSGLTGP | 7103 |
| RSR-2745 | AC1755 | TTARAGGAGNLAPEGLTTP | 7104 |
| RSR-2746 | AC1756 | TTSRAGAAENLTPTGLTGP | 7105 |
| RSR-2747 | AC1757 | TYGRTTTPGNEPPASLEAE | 7106 |
| RSR-2748 | AC1758 | TYSRGESGPNEPPPGLTGP | 7107 |
| RSR-2749 | AC1759 | AWGRTGASENETPAPLGGE | 7108 |
| RSR-2750 | AC1760 | RWGRAETTPNTPPEGLETE | 7109 |
| RSR-2751 | AC1765 | ESGRAANHTGAEPPELGAG | 7110 |
| RSR-2754 | AC1801 | TTGRAGEAANLTPAGLTES | 7111 |
| RSR-2755 | AC1802 | TTGRAGEAANLTPAALTES | 7112 |
| RSR-2756 | AC1803 | TTGRAGEAANLTPAPLTES | 7113 |

TABLE 8a-continued

BP Release Segment Sequences.

| Name | Construct ID | Amino Acid Sequence | SEQ ID NO |
|---|---|---|---|
| RSR-2757 | AC1804 | TTGRAGEAANLTPEPLTES | 7114 |
| RSR-2758 | AC1805 | TTGRAGEAANLTPAGLTGA | 7115 |
| RSR-2759 | AC1806 | TTGRAGEAANLTPEGLTGA | 7116 |
| RSR-2760 | AC1807 | TTGRAGEAANLTPEPLTGA | 7117 |
| RSR-2761 | AC1808 | TTGRAGEAANLTPAGLTEA | 7118 |
| RSR-2762 | AC1809 | TTGRAGEAANLTPEGLTEA | 7119 |
| RSR-2763 | AC1810 | TTGRAGEAANLTPAPLTEA | 7120 |
| RSR-2764 | AC1811 | TTGRAGEAANLTPEPLTEA | 7121 |
| RSR-2765 | AC1812 | TTGRAGEAANLTPEPLTGP | 7122 |
| RSR-2766 | AC1813 | TTGRAGEAANLTPAGLTGG | 7123 |
| RSR-2767 | AC1814 | TTGRAGEAANLTPEGLTGG | 7124 |
| RSR-2768 | AC1815 | TTGRAGEAANLTPEALTGG | 7125 |
| RSR-2769 | AC1816 | TTGRAGEAANLTPEPLTGG | 7126 |
| RSR-2770 | AC1817 | TTGRAGEAANLTPAGLTEG | 7127 |
| RSR-2771 | AC1818 | TTGRAGEAANLTPEGLTEG | 7128 |
| RSR-2772 | AC1819 | TTGRAGEAANLTPAPLTEG | 7129 |
| RSR-2773 | AC1820 | TTGRAGEAANLTPEPLTEG | 7130 |

TABLE 8b

Release Segment Sequences

| Name | Amino Acid Sequence | SEQ ID NO: |
|---|---|---|
| RSN-0001 | GSAPGSAGGYAELRMGGAIATSGSETPGT | 7131 |
| RSN-0002 | GSAPGTGGGYAPLRMGGGAATSGSETPGT | 7132 |
| RSN-0003 | GSAPGAEGGYAALRMGGEIATSGSETPGT | 7133 |
| RSN-0004 | GSAPGGPGGYALLRMGGPAATSGSETPGT | 7134 |
| RSN-0005 | GSAPGEAGGYAFLRMGGSIATSGSETPGT | 7135 |
| RSN-0006 | GSAPGPGGGYASLRMGGTAATSGSETPGT | 7136 |
| RSN-0007 | GSAPGSEGGYATLRMGGAIATSGSETPGT | 7137 |
| RSN-0008 | GSAPGTPGGYANLRMGGGAATSGSETPGT | 7138 |
| RSN-0009 | GSAPGASGGYAHLRMGGEIATSGSETPGT | 7139 |
| RSN-0010 | GSAPGGTGGYGELRMGGPAATSGSETPGT | 7140 |
| RSN-0011 | GSAPGEAGGYPELRMGGSIATSGSETPGT | 7141 |
| RSN-0012 | GSAPGPGGGYVELRMGGTAATSGSETPGT | 7142 |
| RSN-0013 | GSAPGSEGGYLELRMGGAIATSGSETPGT | 7143 |
| RSN-0014 | GSAPGTPGGYSELRMGGGAATSGSETPGT | 7144 |
| RSN-0015 | GSAPGASGGYTELRMGGEIATSGSETPGT | 7145 |
| RSN-0016 | GSAPGGTGGYQELRMGGPAATSGSETPGT | 7146 |
| RSN-0017 | GSAPGEAGGYEELRMGGSIATSGSETPGT | 7147 |
| RSN-0018 | GSAPGPGIGPAELRMGGTAATSGSETPGT | 7148 |
| RSN-0019 | GSAPGSEIGAAELRMGGAIATSGSETPGT | 7149 |
| RSN-0020 | GSAPGTPIGSAELRMGGGAATSGSETPGT | 7150 |
| RSN-0021 | GSAPGASIGTAELRMGGEIATSGSETPGT | 7151 |
| RSN-0022 | GSAPGGTIGNAELRMGGPAATSGSETPGT | 7152 |
| RSN-0023 | GSAPGEAIGQAELRMGGSIATSGSETPGT | 7153 |
| RSN-0024 | GSAPGPGGPYAELRMGGTAATSGSETPGT | 7154 |
| RSN-0025 | GSAPGSEGAYAELRMGGAIATSGSETPGT | 7155 |
| RSN-0026 | GSAPGTPGVYAELRMGGGAATSGSETPGT | 7156 |
| RSN-0027 | GSAPGASGLYAELRMGGEIATSGSETPGT | 7157 |
| RSN-0028 | GSAPGGTGIYAELRMGGPAATSGSETPGT | 7158 |
| RSN-0029 | GSAPGEAGFYAELRMGGSIATSGSETPGT | 7159 |
| RSN-0030 | GSAPGPGGYYAELRMGGTAATSGSETPGT | 7160 |
| RSN-0031 | GSAPGSEGSYAELRMGGAIATSGSETPGT | 7161 |
| RSN-0032 | GSAPGTPGNYAELRMGGGAATSGSETPGT | 7162 |
| RSN-0033 | GSAPGASGEYAELRMGGEIATSGSETPGT | 7163 |
| RSN-0034 | GSAPGGTGHYAELRMGGPAATSGSETPGT | 7164 |
| RSN-0035 | GSAPGEAGGYAEARMGGSIATSGSETPGT | 7165 |

TABLE 8b-continued

Release Segment Sequences

| Name | Amino Acid Sequence | SEQ ID NO: |
|---|---|---|
| RSN-0036 | GSAPGPGGGYAEVRMGGTAATSGSETPGT | 7166 |
| RSN-0037 | GSAPGSEGGYAEIRMGGAIATSGSETPGT | 7167 |
| RSN-0038 | GSAPGTPGGYAEFRMGGGAATSGSETPGT | 7168 |
| RSN-0039 | GSAPGASGGYAEYRMGGEIATSGSETPGT | 7169 |
| RSN-0040 | GSAPGGTGGYAESRMGGPAATSGSETPGT | 7170 |
| RSN-0041 | GSAPGEAGGYAETRMGGSIATSGSETPGT | 7171 |
| RSN-0042 | GSAPGPGGGYAELAMGGTRATSGSETPGT | 7172 |
| RSN-0043 | GSAPGSEGGYAELVMGGARATSGSETPGT | 7173 |
| RSN-0044 | GSAPGTPGGYAELLMGGGRATSGSETPGT | 7174 |
| RSN-0045 | GSAPGASGGYAELIMGGERATSGSETPGT | 7175 |
| RSN-0046 | GSAPGGTGGYAELWMGGPRATSGSETPGT | 7176 |
| RSN-0047 | GSAPGEAGGYAELSMGGSRATSGSETPGT | 7177 |
| RSN-0048 | GSAPGPGGGYAELTMGGTRATSGSETPGT | 7178 |
| RSN-0049 | GSAPGSEGGYAELQMGGARATSGSETPGT | 7179 |
| RSN-0050 | GSAPGTPGGYAELNMGGGRATSGSETPGT | 7180 |
| RSN-0051 | GSAPGASGGYAELEMGGERATSGSETPGT | 7181 |
| RSN-0052 | GSAPGGTGGYAELRPGGPIATSGSETPGT | 7182 |
| RSN-0053 | GSAPGEAGGYAELRAGGSAATSGSETPGT | 7183 |
| RSN-0054 | GSAPGPGGGYAELRLGGTIATSGSETPGT | 7184 |
| RSN-0055 | GSAPGSEGGYAELRIGGAAATSGSETPGT | 7185 |
| RSN-0056 | GSAPGTPGGYAELRSGGGIATSGSETPGT | 7186 |
| RSN-0057 | GSAPGASGGYAELRNGGEAATSGSETPGT | 7187 |
| RSN-0058 | GSAPGGTGGYAELRQGGPIATSGSETPGT | 7188 |
| RSN-0059 | GSAPGEAGGYAELRDGGSAATSGSETPGT | 7189 |
| RSN-0060 | GSAPGPGGGYAELREGGTIATSGSETPGT | 7190 |
| RSN-0061 | GSAPGSEGGYAELRHGGAAATSGSETPGT | 7191 |
| RSN-0062 | GSAPGTPGGYAELRMPGGIATSGSETPGT | 7192 |
| RSN-0063 | GSAPGASGGYAELRMAGEAATSGSETPGT | 7193 |
| RSN-0064 | GSAPGGTGGYAELRMVGPIATSGSETPGT | 7194 |
| RSN-0065 | GSAPGEAGGYAELRMLGSAATSGSETPGT | 7195 |
| RSN-0066 | GSAPGPGGGYAELRMIGTIATSGSETPGT | 7196 |
| RSN-0067 | GSAPGSEGGYAELRMYGAIATSGSETPGT | 7197 |
| RSN-0068 | GSAPGTPGGYAELRMSGGAATSGSETPGT | 7198 |
| RSN-0069 | GSAPGASGGYAELRMNGEIATSGSETPGT | 7199 |
| RSN-0070 | GSAPGGTGGYAELRMQGPAATSGSETPGT | 7200 |
| RSN-0071 | GSAPGANHTPAGLTGPGARATSGSETPGT | 7201 |
| RSN-0072 | GSAPGANTAPEGLTGPSTRATSGSETPGT | 7202 |
| RSN-0073 | GSAPGTGAPPGGLTGPGTRATSGSETPGT | 7203 |
| RSN-0074 | GSAPGANHEPSGLTEGSPRATSGSETPGT | 7204 |
| RSN-0075 | GSAPGANTEPPELGAGTERATSGSETPGT | 7205 |
| RSN-0076 | GSAPGASGPPPGLTGPPGRATSGSETPGT | 7206 |
| RSN-0077 | GSAPGASGTPAPLGGEPGRATSGSETPGT | 7207 |
| RSN-0078 | GSAPGPAGPPEGLETEAGRATSGSETPGT | 7208 |
| RSN-0079 | GSAPGPTSGQGGLTGPESRATSGSETPGT | 7209 |
| RSN-0080 | GSAPGSAGGAANLVRGGAIATSGSETPGT | 7210 |
| RSN-0081 | GSAPGTGGGAAPLVRGGGAATSGSETPGT | 7211 |
| RSN-0082 | GSAPGAEGGAAALVRGGEIATSGSETPGT | 7212 |
| RSN-0083 | GSAPGGPGGAALLVRGGPAATSGSETPGT | 7213 |
| RSN-0084 | GSAPGEAGGAAFLVRGGSIATSGSETPGT | 7214 |
| RSN-0085 | GSAPGPGGGAASLVRGGTAATSGSETPGT | 7215 |

TABLE 8b-continued

Release Segment Sequences

| Name | Amino Acid Sequence | SEQ ID NO: |
|---|---|---|
| RSN-0086 | GSAPGSEGGAATLVRGGAIATSGSETPGT | 7216 |
| RSN-0087 | GSAPGTPGGAAGLVRGGGAATSGSETPGT | 7217 |
| RSN-0088 | GSAPGASGGAADLVRGGEIATSGSETPGT | 7218 |
| RSN-0089 | GSAPGGTGGAGNLVRGGPAATSGSETPGT | 7219 |
| RSN-0090 | GSAPGEAGGAPNLVRGGSIATSGSETPGT | 7220 |
| RSN-0091 | GSAPGPGGGAVNLVRGGTAATSGSETPGT | 7221 |
| RSN-0092 | GSAPGSEGGALNLVRGGAIATSGSETPGT | 7222 |
| RSN-0093 | GSAPGTPGGASNLVRGGGAATSGSETPGT | 7223 |
| RSN-0094 | GSAPGASGGATNLVRGGEIATSGSETPGT | 7224 |
| RSN-0095 | GSAPGGTGGAQNLVRGGPAATSGSETPGT | 7225 |
| RSN-0096 | GSAPGEAGGAENLVRGGSIATSGSETPGT | 7226 |
| RSN-1517 | GSAPEAGRSANHEPLGLVATATSGSETPGT | 7227 |
| BSRS-A1-2 | GSAPASGRSTNAGPSGLAGPATSGSETPGT | 7228 |
| BSRS-A2-2 | GSAPASGRSTNAGPQGLAGQATSGSETPGT | 7229 |
| BSRS-A3-2 | GSAPASGRSTNAGPPGLTGPATSGSETPGT | 7230 |
| VP-1 | GSAPASSRGTNAGPAGLTGPATSGSETPGT | 7231 |
| RSN-1752 | GSAPASSRTTNTGPSTLTGPATSGSETPGT | 7232 |
| RSN-1512 | GSAPAAGRSDNGTPLELVAPATSGSETPGT | 7233 |
| RSN-1517 | GSAPEAGRSANHEPLGLVATATSGSETPGT | 7234 |
| VP-2 | GSAPASGRGTNAGPAGLTGPATSGSETPGT | 7235 |
| RSN-1018 | GSAPLFGRNDNHEPLELGGGATSGSETPGT | 7236 |
| RSN-1053 | GSAPTAGRSDNLEPLGLVFGATSGSETPGT | 7237 |
| RSN-1059 | GSAPLDGRSDNFHPPELVAGATSGSETPGT | 7238 |
| RSN-1065 | GSAPLEGRSDNEEPENLVAGATSGSETPGT | 7239 |
| RSN-1167 | GSAPLKGRSDNNAPLALVAGATSGSETPGT | 7240 |

TABLE 8b-continued

Release Segment Sequences

| Name | Amino Acid Sequence | SEQ ID NO: |
|---|---|---|
| RSN-1201 | GSAPVYSRGTNAGPHGLTGRATSGSETPGT | 7241 |
| RSN-1218 | GSAPANSRGTNKGFAGLIGPATSGSETPGT | 7242 |
| RSN-1226 | GSAPASSRLTNEAPAGLTIPATSGSETPGT | 7243 |
| RSN-1254 | GSAPDQSRGTNAGPEGLTDPATSGSETPGT | 7244 |
| RSN-1256 | GSAPESSRGTNIGQGGLTGPATSGSETPGT | 7245 |
| RSN-1261 | GSAPSSSRGTNQDPAGLTIPATSGSETPGT | 7246 |
| RSN-1293 | GSAPASSRGQNHSPMGLTGPATSGSETPGT | 7247 |
| RSN-1309 | GSAPAYSRGPNAGPAGLEGRATSGSETPGT | 7248 |
| RSN-1326 | GSAPASERGNNAGPANLTGFATSGSETPGT | 7249 |
| RSN-1345 | GSAPASHRGTNPKPAILTGPATSGSETPGT | 7250 |
| RSN-1354 | GSAPMSSRRTNANPAQLTGPATSGSETPGT | 7251 |
| RSN-1426 | GSAPGAGRTDNHEPLELGAAATSGSETPGT | 7252 |
| RSN-1478 | GSAPLAGRSENTAPLELTAGATSGSETPGT | 7253 |
| RSN-1479 | GSAPLEGRPDNHEPLALVASATSGSETPGT | 7254 |
| RSN-1496 | GSAPLSGRSDNEEPLALPAGATSGSETPGT | 7255 |
| RSN-1508 | GSAPEAGRTDNHEPLELSAPATSGSETPGT | 7256 |
| RSN-1513 | GSAPEGGRSDNHGPLELVSGATSGSETPGT | 7257 |
| RSN-1516 | GSAPLSGRSDNEAPLELEAGATSGSETPGT | 7258 |
| RSN-1524 | GSAPLGGRADNHEPPELGAGATSGSETPGT | 7259 |
| RSN-1622 | GSAPPPSRGTNAEPAGLTGEATSGSETPGT | 7260 |
| RSN-1629 | GSAPASTRGENAGPAGLEAPATSGSETPGT | 7261 |
| RSN-1664 | GSAPESSRGTNGAPEGLTGPATSGSETPGT | 7262 |
| RSN-1667 | GSAPASSRATNESPAGLTGEATSGSETPGT | 7263 |
| RSN-1709 | GSAPASSRGENPPPGGLTGPATSGSETPGT | 7264 |
| RSN-1712 | GSAPAASRGTNTGPAELTGSATSGSETPGT | 7265 |

TABLE 8b-continued

Release Segment Sequences

| Name | Amino Acid Sequence | SEQ ID NO: |
|---|---|---|
| RSN-1727 | GSAPAGSRTTNAGPGGLEGPATSGSETPGT | 7266 |
| RSN-1754 | GSAPAPSRGENAGPATLTGAATSGSETPGT | 7267 |
| RSN-1819 | GSAPESGRAANTGPPTLTAPATSGSETPGT | 7268 |
| RSN-1832 | GSAPNPGRAANEGPPGLPGSATSGSETPGT | 7269 |
| RSN-1855 | GSAPESSRAANLTPPELTGPATSGSETPGT | 7270 |
| RSN-1911 | GSAPASGRAANETPPGLTGAATSGSETPGT | 7271 |
| RSN-1929 | GSAPNSGRGENLGAPGLTGTATSGSETPGT | 7272 |
| RSN-1951 | GSAPTTGRAANLTPAGLTGPATSGSETPGT | 7273 |
| RSN-2295 | GSAPEAGRSANHTPAGLTGPATSGSETPGT | 7274 |
| RSN-2298 | GSAPESGRAANTTPAGLTGPATSGSETPGT | 7275 |
| RSN-2038 | GSAPTTGRATEAANLTPAGLTGPATSGSETPGT | 7276 |
| RSN-2072 | GSAPTTGRAEEAANLTPAGLTGPATSGSETPGT | 7277 |
| RSN-2089 | GSAPTTGRAGEAANLTPAGLTGPATSGSETPGT | 7278 |
| RSN-2302 | GSAPTTGRATEAANATPAGLTGPATSGSETPGT | 7279 |
| RSN-3047 | GSAPTTGRAGEAEGATSAGATGPATSGSETPGT | 7280 |
| RSN-3052 | GSAPTTGEAGEAANATSAGATGPATSGSETPGT | 7281 |
| RSN-3043 | GSAPTTGEAGEAAGLTPAGLTGPATSGSETPGT | 7282 |
| RSN-3041 | GSAPTTGAAGEAANATPAGLTGPATSGSETPGT | 7283 |
| RSN-3044 | GSAPTTGRAGEAAGLTPAGLTGPATSGSETPGT | 7284 |
| RSN-3057 | GSAPTTGRAGEAANATSAGATGPATSGSETPGT | 7285 |
| RSN-3058 | GSAPTTGEAGEAAGATSAGATGPATSGSETPGT | 7286 |
| RSN-2485 | GSAPESGRAANTEPPELGAGATSGSETPGT | 7287 |
| RSN-2486 | GSAPESGRAANTAPEGLTGPATSGSETPGT | 7288 |
| RSN-2488 | GSAPEPGRAANHEPSGLTEGATSGSETPGT | 7289 |
| RSN-2599 | GSAPESGRAANHTGAPPGGLTGPATSGSETPGT | 7290 |
| RSN-2706 | GSAPTTGRTGEGANATPGGLTGPATSGSETPGT | 7291 |
| RSN-2707 | GSAPRTGRSGEAANETPEGLEGPATSGSETPGT | 7292 |
| RSN-2708 | GSAPRTGRTGESANETPAGLGGPATSGSETPGT | 7293 |
| RSN-2709 | GSAPSTGRTGEPANETPAGLSGPATSGSETPGT | 7294 |
| RSN-2710 | GSAPTTGRAGEPANATPTGLSGPATSGSETPGT | 7295 |
| RSN-2711 | GSAPRTGRPGEGANATPTGLPGPATSGSETPGT | 7296 |
| RSN-2712 | GSAPRTGRGGEAANATPSGLGGPATSGSETPGT | 7297 |
| RSN-2713 | GSAPSTGRSGESANATPGGLGGPATSGSETPGT | 7298 |
| RSN-2714 | GSAPRTGRTGEEANATPAGLPGPATSGSETPGT | 7299 |
| RSN-2715 | GSAPATGRPGEPANTTPEGLEGPATSGSETPGT | 7300 |
| RSN-2716 | GSAPSTGRSGEPANATPGGLTGPATSGSETPGT | 7301 |
| RSN-2717 | GSAPPTGRGGEGANTTPTGLPGPATSGSETPGT | 7302 |
| RSN-2718 | GSAPPTGRSGEGANATPSGLTGPATSGSETPGT | 7303 |
| RSN-2719 | GSAPTTGRASEGANSTPAPLTEPATSGSETPGT | 7304 |
| RSN-2720 | GSAPTYGRAAEAANTTPAGLTAPATSGSETPGT | 7305 |
| RSN-2721 | GSAPTTGRATEGANATPAELTEPATSGSETPGT | 7306 |
| RSN-2722 | GSAPTVGRASEEANTTPASLTGPATSGSETPGT | 7307 |
| RSN-2723 | GSAPTTGRAPEAANATPAPLTGPATSGSETPGT | 7308 |
| RSN-2724 | GSAPTWGRATEPANATPAPLTSPATSGSETPGT | 7309 |
| RSN-2725 | GSAPTVGRASESANATPAELTSPATSGSETPGT | 7310 |
| RSN-2726 | GSAPTVGRAPEGANSTPAGLTGPATSGSETPGT | 7311 |
| RSN-2727 | GSAPTWGRATEAPNLEPATLTTPATSGSETPGT | 7312 |
| RSN-2728 | GSAPTTGRATEAPNLTPAPLTEPATSGSETPGT | 7313 |
| RSN-2729 | GSAPTQGRATEAPNLSPAALTSPATSGSETPGT | 7314 |
| RSN-2730 | GSAPTQGRAAEAPNLTPATLTAPATSGSETPGT | 7315 |

TABLE 8b-continued

Release Segment Sequences

| Name | Amino Acid Sequence | SEQ ID NO: |
|---|---|---|
| RSN-2731 | GSAPTSGRAPEATNLAPAPLTGPATSGSETPGT | 7316 |
| RSN-2732 | GSAPTQGRAAEAANLTPAGLTEPATSGSETPGT | 7317 |
| RSN-2733 | GSAPTTGRAGSAPNLPPTGLTTPATSGSETPGT | 7318 |
| RSN-2734 | GSAPTTGRAGGAENLPPEGLTAPATSGSETPGT | 7319 |
| RSN-2735 | GSAPTTSRAGTATNLTPEGLTAPATSGSETPGT | 7320 |
| RSN-2736 | GSAPTTGRAGTATNLPPSGLTTPATSGSETPGT | 7321 |
| RSN-2737 | GSAPTTARAGEAENLSPSGLTAPATSGSETPGT | 7322 |
| RSN-2738 | GSAPTTGRAGGAGNLAPGGLTEPATSGSETPGT | 7323 |
| RSN-2739 | GSAPTTGRAGTATNLPPEGLTGPATSGSETPGT | 7324 |
| RSN-2740 | GSAPTTGRAGGAANLAPTGLTEPATSGSETPGT | 7325 |
| RSN-2741 | GSAPTTGRAGTAENLAPSGLTTPATSGSETPGT | 7326 |
| RSN-2742 | GSAPTTGRAGSATNLGPGGLTGPATSGSETPGT | 7327 |
| RSN-2743 | GSAPTTARAGGAENLTPAGLTEPATSGSETPGT | 7328 |
| RSN-2744 | GSAPTTARAGSAENLSPSGLTGPATSGSETPGT | 7329 |
| RSN-2745 | GSAPTTARAGGAGNLAPEGLTTPATSGSETPGT | 7330 |
| RSN-2746 | GSAPTTSRAGAAENLTPTGLTGPATSGSETPGT | 7331 |
| RSN-2747 | GSAPTYGRTTTPGNEPPASLEAEATSGSETPGT | 7332 |
| RSN-2748 | GSAPTYSRGESGPNEPPPGLTGPATSGSETPGT | 7333 |
| RSN-2749 | GSAPAWGRTGASENETPAPLGGEATSGSETPGT | 7334 |
| RSN-2750 | GSAPRWGRAETTPNTPPEGLTEATSGSETPGT | 7335 |
| RSN-2751 | GSAPESGRAANHTGAEPPELGAGATSGSETPGT | 7336 |
| RSN-2754 | GSAPTTGRAGEAANLTPAGLTESATSGSETPGT | 7337 |
| RSN-2755 | GSAPTTGRAGEAANLTPAALTESATSGSETPGT | 7338 |
| RSN-2756 | GSAPTTGRAGEAANLTPAPLTESATSGSETPGT | 7339 |
| RSN-2757 | GSAPTTGRAGEAANLTPEPLTESATSGSETPGT | 7340 |
| RSN-2758 | GSAPTTGRAGEAANLTPAGLTGAATSGSETPGT | 7341 |
| RSN-2759 | GSAPTTGRAGEAANLTPEGLTGAATSGSETPGT | 7342 |
| RSN-2760 | GSAPTTGRAGEAANLTPEPLTGAATSGSETPGT | 7343 |
| RSN-2761 | GSAPTTGRAGEAANLTPAGLTEAATSGSETPGT | 7344 |
| RSN-2762 | GSAPTTGRAGEAANLTPEGLTEAATSGSETPGT | 7345 |
| RSN-2763 | GSAPTTGRAGEAANLTPAPLTEAATSGSETPGT | 7346 |
| RSN-2764 | GSAPTTGRAGEAANLTPEPLTEAATSGSETPGT | 7347 |
| RSN-2765 | GSAPTTGRAGEAANLTPEPLTGPATSGSETPGT | 7348 |
| RSN-2766 | GSAPTTGRAGEAANLTPAGLTGGATSGSETPGT | 7349 |
| RSN-2767 | GSAPTTGRAGEAANLTPEGLTGGATSGSETPGT | 7350 |
| RSN-2768 | GSAPTTGRAGEAANLTPEALTGGATSGSETPGT | 7351 |
| RSN-2769 | GSAPTTGRAGEAANLTPEPLTGGATSGSETPGT | 7352 |
| RSN-2770 | GSAPTTGRAGEAANLTPAGLTEGATSGSETPGT | 7353 |
| RSN-2771 | GSAPTTGRAGEAANLTPEGLTEGATSGSETPGT | 7354 |
| RSN-2772 | GSAPTTGRAGEAANLTPAPLTEGATSGSETPGT | 7355 |
| RSN-2773 | GSAPTTGRAGEAANLTPEPLTEGATSGSETPGT | 7356 |
| RSN-3047 | GSAPTTGRAGEAEGATSAGATGPATSGSETPGT | 7357 |
| RSN-2783 | GSAPEAGRSAEATSAGATGPATSGSETPGT | 7358 |
| RSN-3107 | GSAPSASGTYSRGESPGSPATSGSETPGT | 7359 |
| RSN-3103 | GSAPSASGEAGRTDTHPGSPATSGSETPGT | 7360 |
| RSN-3102 | GSAPSASGEPGRAAEHPGSPATSGSETPGT | 7361 |
| RSN-3119 | GSAPSPAGESSRGTTIAGSPATSGSETPGT | 7362 |
| RSN-3043 | GSAPTTGEAGEAAGLTPAGLTGPATSGSETPGT | 7363 |
| RSN-2789 | GSAPEAGESAGATPAGLTGPATSGSETPGT | 7364 |
| RSN-3109 | GSAPSASGAPLELEAGPGSPATSGSETPGT | 7365 |

TABLE 8b-continued

Release Segment Sequences

| Name | Amino Acid Sequence | SEQ ID NO: |
|---|---|---|
| RSN-3110 | GSAPSASGEPPELGAGPGSPATSGSETPGT | 7366 |
| RSN-3111 | GSAPSASGEPSGLTEGPGSPATSGSETPGT | 7367 |
| RSN-3112 | GSAPSASGTPAPLTEPPGSPATSGSETPGT | 7368 |
| RSN-3113 | GSAPSASGTPAELTEPPGSPATSGSETPGT | 7369 |
| RSN-3114 | GSAPSASGPPPGLTGPPGSPATSGSETPGT | 7370 |
| RSN-3115 | GSAPSASGTPAPLGGEPGSPATSGSETPGT | 7371 |
| RSN-3125 | GSAPSPAGAPEGLTGPAGSPATSGSETPGT | 7372 |
| RSN-3126 | GSAPSPAGPPEGLETEAGSPATSGSETPGT | 7373 |
| RSN-3127 | GSAPSPTSGQGGLTGPGSEPATSGSETPGT | 7374 |
| RSN-3131 | GSAPSESAPPEGLETESTEPATSGSETPGT | 7375 |
| RSN-3132 | GSAPSEGSEPLELGAASETPATSGSETPGT | 7376 |
| RSN-3133 | GSAPSEGSGPAGLEAPSETPATSGSETPGT | 7377 |
| RSN-3138 | GSAPSEPTPPASLEAEPGSPATSGSETPGT | 7378 |
| RSC-0001 | GTAEAASASGGSAGGYAELRMGGAIPGSP | 7379 |
| RSC-0002 | GTAEAASASGGTGGGYAPLRMGGGAPGSP | 7380 |
| RSC-0003 | GTAEAASASGGAEGGYAALRMGGEIPGSP | 7381 |
| RSC-0004 | GTAEAASASGGGPGGYALLRMGGPAPGSP | 7382 |
| RSC-0005 | GTAEAASASGGEAGGYAFLRMGGSIPGSP | 7383 |
| RSC-0006 | GTAEAASASGGPGGGYASLRMGGTAPGSP | 7384 |
| RSC-0007 | GTAEAASASGGSEGGYATLRMGGAIPGSP | 7385 |
| RSC-0008 | GTAEAASASGGTPGGYANLRMGGGAPGSP | 7386 |
| RSC-0009 | GTAEAASASGGASGGYAHLRMGGEIPGSP | 7387 |
| RSC-0010 | GTAEAASASGGGTGGYGELRMGGPAPGSP | 7388 |
| RSC-0011 | GTAEAASASGGEAGGYPELRMGGSIPGSP | 7389 |
| RSC-0012 | GTAEAASASGGPGGGYVELRMGGTAPGSP | 7390 |
| RSC-0013 | GTAEAASASGGSEGGYLELRMGGAIPGSP | 7391 |
| RSC-0014 | GTAEAASASGGTPGGYSELRMGGGAPGSP | 7392 |
| RSC-0015 | GTAEAASASGGASGGYTELRMGGEIPGSP | 7393 |
| RSC-0016 | GTAEAASASGGGTGGYQELRMGGPAPGSP | 7394 |
| RSC-0017 | GTAEAASASGGEAGGYEELRMGGSIPGSP | 7395 |
| RSC-0018 | GTAEAASASGGPGIGPAELRMGGTAPGSP | 7396 |
| RSC-0019 | GTAEAASASGGSEIGAAELRMGGAIPGSP | 7397 |
| RSC-0020 | GTAEAASASGGTPIGSAELRMGGGAPGSP | 7398 |
| RSC-0021 | GTAEAASASGGASIGTAELRMGGEIPGSP | 7399 |
| RSC-0022 | GTAEAASASGGGTIGNAELRMGGPAPGSP | 7400 |
| RSC-0023 | GTAEAASASGGEAIGQAELRMGGSIPGSP | 7401 |
| RSC-0024 | GTAEAASASGGPGGPYAELRMGGTAPGSP | 7402 |
| RSC-0025 | GTAEAASASGGSEGAYAELRMGGAIPGSP | 7403 |
| RSC-0026 | GTAEAASASGGTPGVYAELRMGGGAPGSP | 7404 |
| RSC-0027 | GTAEAASASGGASGLYAELRMGGEIPGSP | 7405 |
| RSC-0028 | GTAEAASASGGGTGIYAELRMGGPAPGSP | 7406 |
| RSC-0029 | GTAEAASASGGEAGFYAELRMGGSIPGSP | 7407 |
| RSC-0030 | GTAEAASASGGPGGYYAELRMGGTAPGSP | 7408 |
| RSC-0031 | GTAEAASASGGSEGSYAELRMGGAIPGSP | 7409 |
| RSC-0032 | GTAEAASASGGTPGNYAELRMGGGAPGSP | 7410 |
| RSC-0033 | GTAEAASASGGASGEYAELRMGGEIPGSP | 7411 |
| RSC-0034 | GTAEAASASGGGTGHYAELRMGGPAPGSP | 7412 |
| RSC-0035 | GTAEAASASGGEAGGYAEARMGGSIPGSP | 7413 |
| RSC-0036 | GTAEAASASGGPGGGYAEVRMGGTAPGSP | 7414 |
| RSC-0037 | GTAEAASASGGSEGGYAEIRMGGAIPGSP | 7415 |

TABLE 8b-continued

Release Segment Sequences

| Name | Amino Acid Sequence | SEQ ID NO: |
|---|---|---|
| RSC-0038 | GTAEAASASGGTPGGYAEFRMGGGAPGSP | 7416 |
| RSC-0039 | GTAEAASASGGASGGYAEYRMGGEIPGSP | 7417 |
| RSC-0040 | GTAEAASASGGGTGGYAESRMGGPAPGSP | 7418 |
| RSC-0041 | GTAEAASASGGEAGGYAETRMGGSIPGSP | 7419 |
| RSC-0042 | GTAEAASASGGPGGGYAELAMGGTRPGSP | 7420 |
| RSC-0043 | GTAEAASASGGSEGGYAELVMGGARPGSP | 7421 |
| RSC-0044 | GTAEAASASGGTPGGYAELLMGGGRPGSP | 7422 |
| RSC-0045 | GTAEAASASGGASGGYAELIMGGERPGSP | 7423 |
| RSC-0046 | GTAEAASASGGGTGGYAELWMGGPRPGSP | 7424 |
| RSC-0047 | GTAEAASASGGEAGGYAELSMGGSRPGSP | 7425 |
| RSC-0048 | GTAEAASASGGPGGGYAELTMGGTRPGSP | 7426 |
| RSC-0049 | GTAEAASASGGSEGGYAELQMGGARPGSP | 7427 |
| RSC-0050 | GTAEAASASGGTPGGYAELNMGGGRPGSP | 7428 |
| RSC-0051 | GTAEAASASGGASGGYAELEMGGERPGSP | 7429 |
| RSC-0052 | GTAEAASASGGGTGGYAELRPGGPIPGSP | 7430 |
| RSC-0053 | GTAEAASASGGEAGGYAELRAGGSAPGSP | 7431 |
| RSC-0054 | GTAEAASASGGPGGGYAELRLGGTIPGSP | 7432 |
| RSC-0055 | GTAEAASASGGSEGGYAELRIGGAAPGSP | 7433 |
| RSC-0056 | GTAEAASASGGTPGGYAELRSGGGIPGSP | 7434 |
| RSC-0057 | GTAEAASASGGASGGYAELRNGGEAPGSP | 7435 |
| RSC-0058 | GTAEAASASGGGTGGYAELRQGGPIPGSP | 7436 |
| RSC-0059 | GTAEAASASGGEAGGYAELRDGGSAPGSP | 7437 |
| RSC-0060 | GTAEAASASGGPGGGYAELREGGTIPGSP | 7438 |
| RSC-0061 | GTAEAASASGGSEGGYAELRHGGAAPGSP | 7439 |
| RSC-0062 | GTAEAASASGGTPGGYAELRMPGGIPGSP | 7440 |
| RSC-0063 | GTAEAASASGGASGGYAELRMAGEAPGSP | 7441 |
| RSC-0064 | GTAEAASASGGGTGGYAELRMVGPIPGSP | 7442 |
| RSC-0065 | GTAEAASASGGEAGGYAELRMLGSAPGSP | 7443 |
| RSC-0066 | GTAEAASASGGPGGGYAELRMIGTIPGSP | 7444 |
| RSC-0067 | GTAEAASASGGSEGGYAELRMYGAIPGSP | 7445 |
| RSC-0068 | GTAEAASASGGTPGGYAELRMSGGAPGSP | 7446 |
| RSC-0069 | GTAEAASASGGASGGYAELRMNGEIPGSP | 7447 |
| RSC-0070 | GTAEAASASGGGTGGYAELRMQGPAPGSP | 7448 |
| RSC-0071 | GTAEAASASGGANHTPAGLTGPGARPGSP | 7449 |
| RSC-0072 | GTAEAASASGGANTAPEGLTGPSTRPGSP | 7450 |
| RSC-0073 | GTAEAASASGGTGAPPGGLTGPGTRPGSP | 7451 |
| RSC-0074 | GTAEAASASGGANHEPSGLTEGSPRPGSP | 7452 |
| RSC-0075 | GTAEAASASGGANTEPPELGAGTERPGSP | 7453 |
| RSC-0076 | GTAEAASASGGASGPPPGLTGPPGRPGSP | 7454 |
| RSC-0077 | GTAEAASASGGASGTPAPLGGEPGRPGSP | 7455 |
| RSC-0078 | GTAEAASASGGPAGPPEGLETEAGRPGSP | 7456 |
| RSC-0079 | GTAEAASASGGPTSGQGGLTGPESRPGSP | 7457 |
| RSC-0080 | GTAEAASASGGSAGGAANLVRGGAIPGSP | 7458 |
| RSC-0081 | GTAEAASASGGTGGGAAPLVRGGAPGSP | 7459 |
| RSC-0082 | GTAEAASASGGAEGGAAALVRGGEIPGSP | 7460 |
| RSC-0083 | GTAEAASASGGGPGGAALLVRGGPAPGSP | 7461 |
| RSC-0084 | GTAEAASASGGEAGGAAFLVRGGSIPGSP | 7462 |
| RSC-0085 | GTAEAASASGGPGGGAASLVRGGTAPGSP | 7463 |
| RSC-0086 | GTAEAASASGGSEGGAATLVRGGAIPGSP | 7464 |
| RSC-0087 | GTAEAASASGGTPGGAAGLVRGGGAPGSP | 7465 |

TABLE 8b-continued

Release Segment Sequences

| Name | Amino Acid Sequence | SEQ ID NO: |
|---|---|---|
| RSC-0088 | GTAEAASASGGASGGAADLVRGGEIPGSP | 7466 |
| RSC-0089 | GTAEAASASGGGTGGAGNLVRGGPAPGSP | 7467 |
| RSC-0090 | GTAEAASASGGEAGGAPNLVRGGSIPGSP | 7468 |
| RSC-0091 | GTAEAASASGGPGGAVNLVRGGTAPGSP | 7469 |
| RSC-0092 | GTAEAASASGGSEGGALNLVRGGAIPGSP | 7470 |
| RSC-0093 | GTAEAASASGGTPGGASNLVRGGGAPGSP | 7471 |
| RSC-0094 | GTAEAASASGGASGGATNLVRGGEIPGSP | 7472 |
| RSC-0095 | GTAEAASASGGGTGGAQNLVRGGPAPGSP | 7473 |
| RSC-0096 | GTAEAASASGGEAGGAENLVRGGSIPGSP | 7474 |
| RSC-1517 | GTAEAASASGEAGRSANHEPLGLVATPGSP | 7475 |
| BSRS-A1-3 | GTAEAASASGASGRSTNAGPSGLAGPPGSP | 7476 |
| BSRS-A2-3 | GTAEAASASGASGRSTNAGPQGLAGQPGSP | 7477 |
| BSRS-A3-3 | GTAEAASASGASGRSTNAGPPGLTGPPGSP | 7478 |
| VP-1 | GTAEAASASGASSRGTNAGPAGLTGPPGSP | 7479 |
| RSC-1752 | GTAEAASASGASSRTTNTGPSTLTGPPGSP | 7480 |
| RSC-1512 | GTAEAASASGAAGRSDNGTPLELVAPPGSP | 7481 |
| RSC-1517 | GTAEAASASGEAGRSANHEPLGLVATPGSP | 7482 |
| VP-2 | GTAEAASASGASGRGTNAGPAGLTGPPGSP | 7483 |
| RSC-1018 | GTAEAASASGLFGRNDNHEPLELGGGPGSP | 7484 |
| RSC-1053 | GTAEAASASGTAGRSDNLEPLGLVFGPGSP | 7485 |
| RSC-1059 | GTAEAASASGLDGRSDNFHPPELVAGPGSP | 7486 |
| RSC-1065 | GTAEAASASGLEGRSDNEEPENLVAGPGSP | 7487 |
| RSC-1167 | GTAEAASASGLKGRSDNNAPLALVAGPGSP | 7488 |
| RSC-1201 | GTAEAASASGVYSRGTNAGPHGLTGRPGSP | 7489 |
| RSC-1218 | GTAEAASASGANSRGTNKGFAGLIGPPGSP | 7490 |
| RSC-1226 | GTAEAASASGASSRLTNEAPAGLTIPPGSP | 7491 |
| RSC-1254 | GTAEAASASGDQSRGTNAGPEGLTDPPGSP | 7492 |
| RSC-1256 | GTAEAASASGESSRGTNIGQGGLTGPPGSP | 7493 |
| RSC-1261 | GTAEAASASGSSSRGTNQDPAGLTIPPGSP | 7494 |
| RSC-1293 | GTAEAASASGASSRGQNHSPMGLTGPPGSP | 7495 |
| RSC-1309 | GTAEAASASGAYSRGPNAGPAGLEGRPGSP | 7496 |
| RSC-1326 | GTAEAASASGASERGNNAGPANLTGFPGSP | 7497 |
| RSC-1345 | GTAEAASASGASHRGTNPKPAILTGPPGSP | 7498 |
| RSC-1354 | GTAEAASASGMSSRRTNANPAQLTGPPGSP | 7499 |
| RSC-1426 | GTAEAASASGGAGRTDNHEPLELGAAPGSP | 7500 |
| RSC-1478 | GTAEAASASGLAGRSENTAPLELTAGPGSP | 7501 |
| RSC-1479 | GTAEAASASGLEGRPDNHEPLALVASPGSP | 7502 |
| RSC-1496 | GTAEAASASGLSGRSDNEEPLALPAGPGSP | 7503 |
| RSC-1508 | GTAEAASASGEAGRTDNHEPLELSAPPGSP | 7504 |
| RSC-1513 | GTAEAASASGEGGRSDNHGPLELVSGPGSP | 7505 |
| RSC-1516 | GTAEAASASGLSGRSDNEAPLELEAGPGSP | 7506 |
| RSC-1524 | GTAEAASASGLGGRADNHEPPELGAGPGSP | 7507 |
| RSC-1622 | GTAEAASASGPPSRGTNAEPAGLTGEPGSP | 7508 |
| RSC-1629 | GTAEAASASGASTRGENAGPAGLEAPPGSP | 7509 |
| RSC-1664 | GTAEAASASGESSRGTNGAPEGLTGPPGSP | 7510 |
| RSC-1667 | GTAEAASASGASSRATNESPAGLTGEPGSP | 7511 |
| RSC-1709 | GTAEAASASGASSRGENPPPGGLTGPPGSP | 7512 |
| RSC-1712 | GTAEAASASGAASRGTNTGPAELTGSPGSP | 7513 |
| RSC-1727 | GTAEAASASGAGSRTTNAGPGGLEGPPGSP | 7514 |
| RSC-1754 | GTAEAASASGAPSRGENAGPATLTGAPGSP | 7515 |

TABLE 8b-continued

Release Segment Sequences

| Name | Amino Acid Sequence | SEQ ID NO: |
|---|---|---|
| RSC-1819 | GTAEAASASGESGRAANTGPPTLTAPPGSP | 7516 |
| RSC-1832 | GTAEAASASGNPGRAANEGPPGLPGSPGSP | 7517 |
| RSC-1855 | GTAEAASASGESSRAANLTPPELTGPPGSP | 7518 |
| RSC-1911 | GTAEAASASGASGRAANETPPGLTGAPGSP | 7519 |
| RSC-1929 | GTAEAASASGNSGRGENLGAPGLTGTPGSP | 7520 |
| RSC-1951 | GTAEAASASGTTGRAANLTPAGLTGPPGSP | 7521 |
| RSC-2295 | GTAEAASASGEAGRSANHTPAGLTGPPGSP | 7522 |
| RSC-2298 | GTAEAASASGESGRAANTTPAGLTGPPGSP | 7523 |
| RSC-2038 | GTAEAASASGTTGRATEAANLTPAGLTGPPGSP | 7524 |
| RSC-2072 | GTAEAASASGTTGRAEEAANLTPAGLTGPPGSP | 7525 |
| RSC-2089 | GTAEAASASGTTGRAGEAANLTPAGLTGPPGSP | 7526 |
| RSC-2302 | GTAEAASASGTTGRATEAANATPAGLTGPPGSP | 7527 |
| RSC-3047 | GTAEAASASGTTGRAGEAEGATSAGATGPPGSP | 7528 |
| RSC-3052 | GTAEAASASGTTGEAGEAANATSAGATGPPGSP | 7529 |
| RSC-3043 | GTAEAASASGTTGEAGEAAGLTPAGLTGPPGSP | 7530 |
| RSC-3041 | GTAEAASASGTTGAAGEAANATPAGLTGPPGSP | 7531 |
| RSC-3044 | GTAEAASASGTTGRAGEAAGLTPAGLTGPPGSP | 7532 |
| RSC-3057 | GTAEAASASGTTGRAGEAANATSAGATGPPGSP | 7533 |
| RSC-3058 | GTAEAASASGTTGEAGEAAGATSAGATGPPGSP | 7534 |
| RSC-2485 | GTAEAASASGESGRAANTEPPELGAGPGSP | 7535 |
| RSC-2486 | GTAEAASASGESGRAANTAPEGLTGPPGSP | 7536 |
| RSC-2488 | GTAEAASASGEPGRAANHEPSGLTEGPGSP | 7537 |
| RSC-2599 | GTAEAASASGESGRAANHTGAPPGGLTGPPGSP | 7538 |
| RSC-2706 | GTAEAASASGTTGRTGEGANATPGGLTGPPGSP | 7539 |
| RSC-2707 | GTAEAASASGRTGRSGEAANETPEGLEGPPGSP | 7540 |
| RSC-2708 | GTAEAASASGRTGRTGESANETPAGLGGPPGSP | 7541 |
| RSC-2709 | GTAEAASASGSTGRTGEPANETPAGLSGPPGSP | 7542 |
| RSC-2710 | GTAEAASASGTTGRAGEPANATPTGLSGPPGSP | 7543 |
| RSC-2711 | GTAEAASASGRTGRPGEGANATPTGLPGPPGSP | 7544 |
| RSC-2712 | GTAEAASASGRTGRGGEAANATPSGLGGPPGSP | 7545 |
| RSC-2713 | GTAEAASASGSTGRSGESANATPGGLGGPPGSP | 7546 |
| RSC-2714 | GTAEAASASGRTGRTGEEANATPAGLPGPPGSP | 7547 |
| RSC-2715 | GTAEAASASGATGRPGEPANTTPEGLEGPPGSP | 7548 |
| RSC-2716 | GTAEAASASGSTGRSGEPANATPGGLTGPPGSP | 7549 |
| RSC-2717 | GTAEAASASGPTGRGGEGANTTPTGLPGPPGSP | 7550 |
| RSC-2718 | GTAEAASASGPTGRSGEGANATPSGLTGPPGSP | 7551 |
| RSC-2719 | GTAEAASASGTTGRASEGANSTPAPLTEPPGSP | 7552 |
| RSC-2720 | GTAEAASASGTYGRAAEAANTTPAGLTAPPGSP | 7553 |
| RSC-2721 | GTAEAASASGTTGRATEGANATPAELTEPPGSP | 7554 |
| RSC-2722 | GTAEAASASGTVGRASEEANTTPASLTGPPGSP | 7555 |
| RSC-2723 | GTAEAASASGTTGRAPEAANATPAPLTGPPGSP | 7556 |
| RSC-2724 | GTAEAASASGTWGRATEPANATPAPLTSPPGSP | 7557 |
| RSC-2725 | GTAEAASASGTVGRASESANATPAELTSPPGSP | 7558 |
| RSC-2726 | GTAEAASASGTVGRAPEGANSTPAGLTGPPGSP | 7559 |
| RSC-2727 | GTAEAASASGTWGRATEAPNLEPATLTTPPGSP | 7560 |
| RSC-2728 | GTAEAASASGTTGRATEAPNLTPAPLTEPPGSP | 7561 |
| RSC-2729 | GTAEAASASGTQGRATEAPNLSPAALTSPPGSP | 7562 |
| RSC-2730 | GTAEAASASGTQGRAAEAPNLTPATLTAPPGSP | 7563 |
| RSC-2731 | GTAEAASASGTSGRAPEATNLAPAPLTGPPGSP | 7564 |
| RSC-2732 | GTAEAASASGTQGRAAEAANLTPAGLTEPPGSP | 7565 |

TABLE 8b-continued

Release Segment Sequences

| Name | Amino Acid Sequence | SEQ ID NO: |
|---|---|---|
| RSC-2733 | GTAEAASASGTTGRAG SAPNLPPTGLTTPPGSP | 7566 |
| RSC-2734 | GTAEAASASGTTGRAG GAENLPPEGLTAPPGSP | 7567 |
| RSC-2735 | GTAEAASASGTTSRAG TATNLTPEGLTAPPGSP | 7568 |
| RSC-2736 | GTAEAASASGTTGRAG TATNLPPSGLTTPPGSP | 7569 |
| RSC-2737 | GTAEAASASGTTARAG EAENLSPSGLTAPPGSP | 7570 |
| RSC-2738 | GTAEAASASGTTGRAG GAGNLAPGGLTEPPGSP | 7571 |
| RSC-2739 | GTAEAASASGTTGRAG TATNLPPEGLTGPPGSP | 7572 |
| RSC-2740 | GTAEAASASGTTGRAG GAANLAPTGLTEPPGSP | 7573 |
| RSC-2741 | GTAEAASASGTTGRAG TAENLAPSGLTTPPGSP | 7574 |
| RSC-2742 | GTAEAASASGTTGRAG SATNLGPGGLTGPPGSP | 7575 |
| RSC-2743 | GTAEAASASGTTARAG GAENLTPAGLTEPPGSP | 7576 |
| RSC-2744 | GTAEAASASGTTARAG SAENLSPSGLTGPPGSP | 7577 |
| RSC-2745 | GTAEAASASGTTARAG GAGNLAPEGLTTPPGSP | 7578 |
| RSC-2746 | GTAEAASASGTTSRAG AAENLTPTGLTGPPGSP | 7579 |
| RSC-2747 | GTAEAASASGTYGRTT TPGNEPPASLEAEPGSP | 7580 |
| RSC-2748 | GTAEAASASGTYSRGES GPNEPPPGLTGPPGSP | 7581 |
| RSC-2749 | GTAEAASASGAWGRTG ASENETPAPLGGEPGSP | 7582 |
| RSC-2750 | GTAEAASASGRWGRAE TTPNTPPEGLETEPGSP | 7583 |
| RSC-2751 | GTAEAASASGESGRAA NHTGAEPPELGAGPGSP | 7584 |
| RSC-2754 | GTAEAASASGTTGRAG EAANLTPAGLTESPGSP | 7585 |
| RSC-2755 | GTAEAASASGTTGRAG EAANLTPAALTESPGSP | 7586 |
| RSC-2756 | GTAEAASASGTTGRAG EAANLTPAPLTESPGSP | 7587 |
| RSC-2757 | GTAEAASASGTTGRAG EAANLTPEPLTESPGSP | 7588 |
| RSC-2758 | GTAEAASASGTTGRAG EAANLTPAGLTGAPGSP | 7589 |
| RSC-2759 | GTAEAASASGTTGRAG EAANLTPEGLTGAPGSP | 7590 |
| RSC-2760 | GTAEAASASGTTGRAG EAANLTPEPLTGAPGSP | 7591 |
| RSC-2761 | GTAEAASASGTTGRAG EAANLTPAGLTEAPGSP | 7592 |
| RSC-2762 | GTAEAASASGTTGRAG EAANLTPEGLTEAPGSP | 7593 |
| RSC-2763 | GTAEAASASGTTGRAG EAANLTPAPLTEAPGSP | 7594 |
| RSC-2764 | GTAEAASASGTTGRAG EAANLTPEPLTEAPGSP | 7595 |
| RSC-2765 | GTAEAASASGTTGRAG EAANLTPEPLTGPPGSP | 7596 |
| RSC-2766 | GTAEAASASGTTGRAG EAANLTPAGLTGGPGSP | 7597 |
| RSC-2767 | GTAEAASASGTTGRAG EAANLTPEGLTGGPGSP | 7598 |
| RSC-2768 | GTAEAASASGTTGRAG EAANLTPEALTGGPGSP | 7599 |
| RSC-2769 | GTAEAASASGTTGRAG EAANLTPEPLTGGPGSP | 7600 |
| RSC-2770 | GTAEAASASGTTGRAG EAANLTPAGLTEGPGSP | 7601 |
| RSC-2771 | GTAEAASASGTTGRAG EAANLTPEGLTEGPGSP | 7602 |
| RSC-2772 | GTAEAASASGTTGRAG EAANLTPAPLTEGPGSP | 7603 |
| RSC-2773 | GTAEAASASGTTGRAG EAANLTPEPLTEGPGSP | 7604 |
| RSC-3047 | GTAEAASASGTTGRAG EAEGATSAGATGPPGSP | 7605 |
| RSC-2783 | GTAEAASASGEAGRSA EATSAGATGPPGSP | 7606 |
| RSC-3107 | GTAEAASASGSASGTYS RGESGPGSPPGSP | 7607 |
| RSC-3103 | GTAEAASASGSASGEA GRTDTHPGSPPGSP | 7608 |
| RSC-3102 | GTAEAASASGSASGEPG RAAEHPGSPPGSP | 7609 |
| RSC-3119 | GTAEAASASGSPAGESS RGTTIAGSPPGSP | 7610 |
| RSC-3043 | GTAEAASASGTTGEAG EAAGLTPAGLTGPPGSP | 7611 |
| RSC-2789 | GTAEAASASGEAGESA GATPAGLTGPPGSP | 7612 |
| RSC-3109 | GTAEAASASGSASGAPL ELEAGPGSPPGSP | 7613 |
| RSC-3110 | GTAEAASASGSASGEPP ELGAGPGSPPGSP | 7614 |
| RSC-3111 | GTAEAASASGSASGEPS GLTEGPGSPPGSP | 7615 |

TABLE 8b-continued

Release Segment Sequences

| Name | Amino Acid Sequence | SEQ ID NO: |
|---|---|---|
| RSC-3112 | GTAEAASASGSASGTPAPLTEPPGSPPGSP | 7616 |
| RSC-3113 | GTAEAASASGSASGTPAELTEPPGSPPGSP | 7617 |
| RSC-3114 | GTAEAASASGSASGPPPGLTGPPGSPPGSP | 7618 |
| RSC-3115 | GTAEAASASGSASGTPAPLGGEPGSPPGSP | 7619 |
| RSC-3125 | GTAEAASASGSPAGAPEGLTGPAGSPPGSP | 7620 |
| RSC-3126 | GTAEAASASGSPAGPPEGLETEAGSPPGSP | 7621 |
| RSC-3127 | GTAEAASASGSPTSGQGGLTGPGSEPPGSP | 7622 |
| RSC-3131 | GTAEAASASGSESAPPEGLETESTEPPGSP | 7623 |
| RSC-3132 | GTAEAASASGSEGSEPLELGAASETPPGSP | 7624 |
| RSC-3133 | GTAEAASASGSEGSGPAGLEAPSETPPGSP | 7625 |
| RSC-3138 | GTAEAASASGSEPTPPASLEAEPGSPPGSP | 7626 |

In some embodiments, the RS for incorporation into the subject recombinant polypeptides can be designed to be selectively sensitive in order to have different rates of cleavage and different cleavage efficiencies to the various proteases for which they are substrates. As a given protease may be found in different concentrations in diseased tissues, including but not limited to a tumor, a blood cancer, or an inflammatory tissue or site of inflammation, compared to healthy tissues or in the circulation, the disclosure provides RS that have had the individual amino acid sequences engineered to have a higher or lower cleavage efficiency for a given protease in order to ensure that the recombinant polypeptide is preferentially converted from the prodrug form to the active form (i.e., by the separation and release of the binding moieties and XTEN from the recombinant polypeptide after cleavage of the RS) when in proximity to the target cell or tissue and its co-localized proteases compared to the rate of cleavage of the RS in healthy tissue or the circulation such that the released antibody fragment binding moieties have a greater ability to bind to ligands in the diseased tissues compared to the prodrug form that remains in circulation. By such selective designs, the therapeutic index of the resulting compositions can be improved, resulting in reduced side effects relative to convention therapeutics that do not incorporate such site-specific activation.

As used herein cleavage efficiency is defined as the $\log_2$ value of the ratio of the percentage of the test substrate comprising the RS cleaved to the percentage of the control substrate AC1611 cleaved when each is subjected to the protease enzyme in biochemical assays (further detailed in the Examples) in which reaction is conducted wherein the initial substrate concentration is 6 pM, the reactions are incubated at 37° C. for 2 hours before being stopped by adding EDTA, with the amount of digestion products and uncleaved substrate analyzed by non-reducing SDS-PAGE to establish the ratio of the percentage cleaved. The cleavage efficiency is calculated as follows:

$$\text{Log}_2\left(\frac{\% \text{ Cleaved for substrate of interest}}{\% \text{ cleaved for AC1611 in the same experiment}}\right).$$

Thus, a cleavage efficiency of −1 means that the amount of test substrate cleaved was 50% compared to that of the control substrate, while a cleavage efficiency of +1 means that the amount of test substrate cleaved was 200% compared to that of the control substrate. A higher rate of cleavage by the test protease relative to the control would result in a higher cleavage efficiency, and a slower rate of cleavage by the test protease relative to the control would result in a lower cleavage efficiency. As detailed in the Examples, a control RS sequence AC1611 (RSR-1517), having the amino acid sequence EAGRSANHEPLGLVAT (SEQ ID NO: 7001), was established as having an appropriate baseline cleavage efficiency by the proteases legumain, MMP-2, MMP-7, MMP-9, MMP-14, uPA, and matriptase, when tested in in vitro biochemical assays for rates of cleavage by the individual proteases. By selective substitution of amino acids at individual locations in the RS peptides, libraries of RS were created and evaluated against the panel of the 7 proteases (detailed more fully in the Examples), resulting in profiles that were used to establish guidelines for appropriate amino acid substitutions in order to achieve RS with desired cleavage efficiencies. In making RS with desired cleavage efficiencies, substitutions using the hydrophilic amino acids A, E, G, P, S, and T are preferred, however other L-amino acids can be substituted at given positions in order to adjust the cleavage efficiency so long as the RS retains at least some susceptibility to cleavage by a protease. Conservative substitutions of amino acids in a peptide to retain or effect activity is well within the knowledge and capabilities of a person within skill in the art. In one embodiment, the disclosure provides RS in which the RS is cleaved by a protease including but not limited to legumain, MMP-1, MMP-2, MMP-7, MMP-9, MMP-11, MMP-14, uPA, or matriptase with at least a 0.2 log 2, or 0.4 log 2, or 0.8 log 2, or 1.0 $\log_2$ higher cleavage efficiency in an in vitro biochemical competitive assay compared to the cleavage by the same protease of a control sequence RSR-1517 having the sequence EAGRSANHEPLGLVAT (SEQ ID NO. 7001). In some embodiments, the disclosure provides RS in which the RS is cleaved by a protease including but not limited to legumain, MMP-1, MMP-2, MMP-7, MMP-9, MMP-11, MMP-14, uPA, or matriptase with at least a 0.2 $\log_2$, or 0.4 $\log_2$, or 0.8 log 2, or 1.0 $\log_2$ lower cleavage efficiency in an in vitro biochemical competitive assay compared to the cleavage by the same protease of a control sequence RSR-1517 having the sequence EAGRSANHEPLGLVAT (SEQ ID NO. 7001). In one embodiment, the disclosure provides RS in which the rate of cleavage of the RS by a protease including but not limited to legumain, MMP-1, MMP-2, MMP-7, MMP-9, MMP-11, MMP-14, uPA, or matriptase is at least 2-fold, or at least 4-fold, or at least 8 fold, or at least 16-fold faster compared to the control sequence RSR-1517 having the sequence EAGRSANHEPLGLVAT (SEQ ID NO. 7001). In some embodiments, the disclosure provides RS in which the rate of cleavage of the RS by a protease including but not limited to legumain, MMP-1, MMP-2, MMP-7, MMP-9, MMP-11, MMP-14, uPA, or matriptase is at least 2-fold, or at least 4-fold, or at least 8 fold, or at least 16-fold slower compared to the control sequence RSR-1517 having the sequence EAGRSANHEPLGLVAT (SEQ ID NO. 7001).

In some embodiments, the disclosure provides AAC comprising multiple RS wherein each RS sequence is identified herein by the group of sequences set forth in Table 8a and the RS are linked to each other by 1 to 6 amino acids that are glycine, serine, alanine, and threonine. In one embodiment, the AAC comprises a first RS and a second RS different from the first RS wherein each RS sequence is identified herein by the sequences set forth in Table 8a and the RS are linked to each other by 1 to 6 amino acids that are glycine, serine, alanine, and threonine. In some embodiments, the AAC comprises a first RS, a second RS different from the first RS, and a third RS different from the first and the second RS wherein each sequence is identified herein by the sequences set forth in Table 8a and the first and the second and the third RS are linked to each other by 1 to 6 amino acids that are glycine, serine, alanine, and threonine. It is specifically intended that the multiple RS of the AAC can be concatenated to form a sequence that can be cleaved by multiple proteases at different rates or efficiency of cleavage. In some embodiments, the disclosure provides AAC comprising an RS1 and an RS2 identified herein by the sequences set forth in Tables 8a-8b and an XTEN 1 and XTEN 2, such as those described hereinabove or described elsewhere herein, wherein the RS1 is fused between the XTEN1 and the binding moieties and the RS2 is fused between the XTEN2 and the binding moieties. It is contemplated that such compositions would be more readily cleaved by diseased target tissues that express multiple proteases, compared with healthy tissues or when in the normal circulation, with the result that the resulting fragments bearing the binding moieties would more readily penetrate the target tissue; e.g., a tumor, and have an enhanced ability to bind and link the target cell and the effector cell (or just the target cell in the case of AAC designed with a single binding moiety.

The RS of the disclosure are useful for inclusion in recombinant polypeptides as therapeutics for treatment of cancers, autoimmune diseases, inflammatory diseases and other conditions where localized activation of the recombinant polypeptide is desirable. The subject compositions address an unmet need and are superior in one or more aspects including enhanced terminal half-life, targeted delivery, and improved therapeutic ratio with reduced toxicity to healthy tissues compared to conventional antibody therapeutics or bispecific antibody therapeutics that are active upon injection.

In some embodiments, the (fusion) polypeptide comprises a first release segment (RS1) positioned between the (first) XTEN and the biologically active polypeptide. In some embodiments, the polypeptide further comprises a second release segment (RS2) positioned between the biologically active polypeptide and the second XTEN. In some embodiments, RS1 and RS2 are identical in sequence. In some embodiments, RS1 and RS2 are not identical in sequence. In some embodiments, the RS1 comprises an amino acid sequence having at least 90%, 91%, 92%, 93%, 94%, 95%, 96%, 97%, 98%, 99% or 100% sequence identity to a sequence identified herein by those in Tables 8a-8b or a subset thereof. In some embodiments, the RS2 comprises an amino acid sequence having at least 90%, 91%, 92%, 93%, 94%, 95%, 96%, 97%, 98%, 99% or 100% sequence identity to a sequence identified herein by those in Tables 8a-8b or a subset thereof. In some embodiments, the RS1 and RS2 are each a substrate for cleavage by multiple proteases at one, two, or three cleavage sites within each release segment sequence.

Reference Fragment

In some embodiments, the (fusion) polypeptide further comprises one or more reference fragments releasable from the polypeptide upon digestion by the protease. In some embodiments, the one or more reference fragments each comprise a portion of the biologically active polypeptide. In some embodiments, the one or more reference fragments is a single reference fragment that differs in sequence and molecular weight from all other peptide fragments that are releasable from the polypeptide upon digestion of the polypeptide by the protease.

Exemplary Polypeptides

In some embodiments of the compositions of this disclosure, the polypeptide is a recombinant polypeptide comprising an amino acid sequence having at least (about) 80% sequence identity to a sequence set forth in Table D (consisting of SEQ ID NOS: 12-47) or a subset thereof. The polypeptide can comprise an amino acid sequence having at least (about) 81%, at least (about) 82%, at least (about) 83%, at least (about) 84%, at least (about) 85%, at least (about) 86%, at least (about) 87%, at least (about) 88%, at least (about) 89%, at least (about) 90%, at least (about) 91%, at least (about) 92%, at least (about) 93%, at least (about) 94%, at least (about) 95%, at least (about) 96%, at least (about) 97%, at least (about) 98%, at least (about) 99%, or (about) 100% sequence identity to a sequence set forth in Table D (SEQ ID NOS: 12-47) or a subset thereof. The polypeptide can comprise an amino acid sequence having at least (about) 90%, at least (about) 91%, at least (about) 92%, at least (about) 93%, at least (about) 94%, at least (about) 95%, at least (about) 96%, at least (about) 97%, at least (about) 98%, at least (about) 99%, or (about) 100% sequence identity to a sequence set forth in Table D (SEQ ID NOS: 12-47) or a subset thereof. The polypeptide can comprise an amino acid sequence identical to a sequence set forth in Table D (SEQ ID NOS: 12-47) or a subset thereof. It is specifically contemplated that the compositions of this disclosure can comprise sequence variants of the amino acid sequences set forth in Table D, such as with linker sequence(s) inserted or with purification tag sequence(s) attached thereto, so long as the variants exhibit substantially similar or same bioactivity/bioactivities and/or activation mechanism(s).

TABLE D

Exemplary amino acid sequences of polypeptides

| SEQ ID NO. | Amino Acid Sequences |
|---|---|
| 12 | ASSPAGSPTSTESGTSESATPESGPGTSTEPSEGSAPGTSESATPESGPGSEPATSGSETPGTSESATPES GPGSTPAESGSETPGTSESATPESGPGTSTEPSEGSAPGSPAGSPTSTEEGTSESATPESGPGSEPATSGS ETPGTSESATPESGPGSPAGSPTSTEEGSPAGSPTSTEEGTSTEPSEGSAPGTSESATPESGPGTSESATP ESGPGTSESATPESGPGSEPATSGSETPGSEPATSGSETPGSPAGSPTSTEEGTSTEPSEGSAPGTSTEPS EGSAPGGSAPLGGRADNHEPPELGAGATSGSETPGTDIQMTQSPSSLSASVGDRVTITCRASQDVNTAVAW |

TABLE D-continued

Exemplary amino acid sequences of polypeptides

| SEQ ID NO. | Amino Acid Sequences |
|---|---|
|  | YQQKPGKAPKLLIYSASFLYSGVPSRFSGSRSGTDFTLTISSLQPEDFATYYCQQHYTTPPTFGQGTKVEI KGATPPETGAETESPGETTGGSAESEPPGEGEVQLVESGGGLVQPGGSLRLSCAASGFNIKDTYIHWVRQA PGKGLEWVARIYPTNGYTRYADSVKGRFTISADTSKNTAYLQMNSLRAEDTAVYYCSRWGGDGFYAMDYWG QGTLVTVSSGGGSELVVTQEPSLTVSPGGTVTLTCRSSTGAVTTSNYANWVQQKPGQAPRGLIGGTNKRAP GTPARFSGSSLGGSAALTLSGVQPEDEAEYYCALWYSNLWVFGGGTKLTVLGATPPETGAETESPGETTGG SAESEPPGEGEVQLQESGGGLVQPGGSLKLSCAASGFTFNTYAMNWVRQAPGKGLEWVARIRSKYNNYATY YADSVKDRFTISRDDSKNTAYLQMNNLKTEDTAVYYCVRHGNFGNSYVSWFAYWGQGTLVTVSSGTAEAAS ASGLGGRADNHEPPELGAGSAGSPGSPAGSPTSTEEGTSESATPESGPGTSTEPSEGSAPGSPAGSPTSTE EGTSTEPSEGSAPGTSTEPSEGSAPGTSESATPESGPGSESATPGSGSETPGSEPATSGSETPGSPAGSPTST EEGTSESATPESGPGTSTEPSEGSAPGTSTEPSEGSAPGSPAGSPTSTEEGTSTEPSEGSAPGTSTEPSEG SAPGTSESATPESGPGTSTEPSEGSAPGTSESATPESGPGSEPATSGSETPGTSTEPSEGSAPGTSTEPSE GSAPGTSESATPESGPGTSESATPESGPGSPAGSPTSTEEGTSESATPESGPGSEPATSGSETPGTSESAT PESGPGTSTEPSEGSAPGTSTEPSEGSAPGTSTEPSEGSAPGTSTEPSEGSAPGTSTEPSEGSAPGTSTEP SEGSAPGSPAGSPTSTEEGTSTEPSEGSAPGTSESATPESGPGSEPATSGSETPGTSESATPESGPGSEPA TSGSETPGTSESATPESGPGTSTEPSEGSAPGTSESATPESGPGSPAGSPTSTEEGSPAGSPTSTEEGSPA GSPTSTEEGTSESATPESGPGTSTEPSEGSAPGTSESATPESGPGSESETPGTSESATPESGPGSE PATSGSETPGTSESATPESGPGTSTEPSEGSAPGSPAGSPTSTEEGTSESATPESGPGSEPATSGSETPGT SESATPESGPGSPAGSPTSTEEGSPAGSPTSTEEGTSTEPSEGSAPGTSESATPESGPGTSESATPESGPG TSESATPESGPGSEPATSGSETPGSEPATSGSETPGSPAGSPTSTEEGTSTEPSEGSAPGTSTEPSEGSAP GSEPATSGSETPGTSESATPESGPGTSTEPSEGSAPGSPAGSPTSTEEGTSESATPESGPGTSTEPSEGSA PGSPAGSPTSTEEGTSTEPSEGSAPGTSTEPSEGSAPGTSESATPESGPGSEPATSGSETPGSEPATSGST ETPGSPAGSPTSTEEGTSESATPESGPGTSTEPSEGSAPGTSTEPSEGSAPGSPAGSPTSTEEGTSTEPSE GSAPGTATESPEGSAPGTSESATPESGPGTSTEPSEGSAPGTSAESATPESGPGSEPATSGSETPGTSTEP SEGSAPGTSTEPSEGSAPGTSESATPESGPGTSESAS |
| 13 | ASSPAGSPTSTESGTSESATPESGPGTSTEPSEGSAPGTSESATPESGPGSEPATSGSETPGTSESATPES GPGSTPAESGSETPGTSESATPESGPGTSTEPSEGSAPGSPAGSPTSTEEGTSESATPESGPGEEPATSGS TPEGTSESATPESGPGSPAGSPTSTEEGSPAGSPTSTEEGTSTEPSEGSAPGTSESATPESGPGTSESATP ESGPGTSESATPESGPGSEPATSGSETPGSEPATSGSETPGSPAGSPTSTEEGTSTEPSEGSAPGTSTEPS EGSAPGGSAPASTRGENAGPAGLEAPATSGSETPGTDIQMTQSPSSLSASVGDRVTITCKASQDVSIGVAW YQQKPGKAPKLLIYSASYRYTGVPSRFSGSGSGTDFTLTISSLQPEDFATYYCQQYYIYPYTFGQGTKVEI KGATPPETGAETESPGETTGGSAESEPPGEGEVQLVESGGGLVQPGGSLRLSCAASGFTFTDYTMDWVRQA PGKGLEWVADVNPNSGGSIYNQRFKGRFTLSVDRSKNTLYLQMNSLRAEDTAVYYCARNLGPSFYFDYWGQ GTLVTVSSGGGSELVVTQEPSLTVSPGGTVTLTCRSSNGAVTSSNYANWVQQKPGQAPRGLIGGTNKRAPG TPARFSGSLLGGKAALTLSGVQPEDEAVYYCALWYPNLWVFGGGTKLTVLGATPPETGAETESPGETTGGS AESEPPGEGEVQLLESGGGIVQPGGSLKLSCAASGFTFNTYAMNWVRQAPGKGLEWVARIRSKYNNYATYY ADSVKDRFTISRDDSKNTVYLQMNNLKTEDTAVYYCVRHENFGNSYVSWFAHWGQGTLVTVSSGTAEAASA SGASTRGENAGPAGLEAPPGSPAGSPTSTEEGTSESATPESGPGSEPATSGSETPGTSESATPESGPGTST EPSEGSAPGTSTEPSEGSAPGTSTEPSEGSAPGTSTEPSEGSAPGTSTEPSEGSAPGTSTEPSEGSAPGSP AGSPTSTEEGTSTEPSEGSAPGTSESATPESGPGSEPATSGSETPGTSESATPESGPGSEPATSGSETPGT SESATPESGPGTSTEPSEGSAPGTSESATPESGPGSPAGSPTSTEEGSPAGSPTSTEEG TSESATPESGPGTSTEPSEGSAPGTSESATPESGPGSEPATSGSETPGTSESATPESGPGSEPATSGSETP GTSESATPESGPGTSTEPSEGSAPGSPAGSPTSTEEGTSESATPESGPGSEPATSGSETPGTSESATPESG PGSPAGSPTSTEEGSPAGSPTSTEEGTSTEPSEGSAPGTSESATPESGPGTSESATPESGPGTSESATPES GPGSEPATSGSETPGSEPATSGSETPGSPAGSPTSTEEGTSTEPSEGSAPGTESTPSEGSAPGSEPATSGS ETPGTSESATPESGPGTSTEPSEGSAPGEPEA |
| 14 | ASSPAGSPTSTESGTSESATPESGPGTETEPSEGSAPGTSESATPESGPGSEPATSGSETPGTSESATPES GPGSTPAESGSETPGTSESATPESGPGTSTEPSEGSAPGSPAGSPTSTEEGTSESATPESGPGESPATSGS TPEGTSESATPESGPGSPAGSPTSTEEGSPAGSPTSTEEGTSTEPSEGSAPGTSESATPESGPGTSESATP ESGPGTSESATPESGPGSEPATSGSETPGSEPATSGSETPGSPAGSPTSTEEGTSTEPSEGSAPGTSTEPS EGSAPGGSAPEAGRSANHTPAGLTGPATSGSETPGTEIVLTQSPATLSLSPGERATLSCKASQDVSIGVAW YQQKPGKAPRLLIYSASYRYSGVPARFSGSGSGTDFTLTISSLEPEDFAVYYCQQYYIYPYTFGQGTKVEI KGATPPETGAETESPGETTGGSAESEPPGEGQVQLVQSGVEVKKPGASVKVSCKASGFTFTDYTMDWVRQA PGQGLEWMADVNPNSGGSIYNQRFKGRVTLTTDSSTTTAYMELKSLQFDDTAVYYCARNLGPSFYFDYWGQ GTLVTVSSGGGSELVVTQEPSLTVSPGGTVTLTCRSSNGAVTSSNYANWVQQKPGQAPRGLIGGTNKRAPG TPARFSGSSLGGKAALTLSGVQPEDEAVYYCALWYPNLWVFGGGTKLTVLGATPPETGAETESPGETTGGS AESEPPGEGEVQLQESGGGIVQPGGSLKLSCAASGFTFNTYAMNWVRQAPGKGLEWVARIRSKYNNYATYY ADSVKDRFTISRDDSKNTVYLQMNNLKTEDTAVYYCVRHENFGNSYVSWFAHWGQGTLVTVSSGTAEAASA SGEAGRSANHTPAGLTGPTPESGPGTSESATPESGPGSPAGSPTSTEEGTSESATPESGPGSEPATSGSET PGTSESATPESGPGTSTEPSEGSAPGTSTEPSEGSAPGTSTEPSEGSAPGTSTEPSEGSAPGTSTEPSEGS APGTSTEPSEGSAPGSPAGSPTSTEEGTSTEPSEGSAPGTSESATPESGPGSETPGTSESATPE SGPGSEPATSGSETPGTSESATPESGPGTSTEPSEGSAPGTSESATPESGPGSPAGSPTSTEEGSPAGSPT STEEGSPAGSPTSTEEGTSESATPESGPGTSTEPSEGSAPGTSESATPESGPGSEPATSGSETPGTSESAT PESGPGSEPATSGSETPGTSESATPESGPGTSTEPSEGSAPGSPAGSPTSTEEGTSESATPESGPGSEPAT SGSETPGTSESATPESGPGSPAGSPTSTEEGSPAGSPTSTEEGTSTEPSEGSAPGTSESATPESGPGTSES ATPESGPGTSESATPESGPGSEPATSGSETPGSEPATSGSETPGSPAGSPTSTEEGTSTEPSEGSAPGTST EPSEGSAPGSEPATSGSETPGTSESA |
| 15 | SPAGSPTSTESGTSESATPESGPGTSTEPSEGSAPGTSESATPESGPGSEPATSGSETPGTSESATPESGP GSTPAESGSETPGTSESATPESGPGTSTEPSEGSAPGSPAGSPTSTEEGTSESATPESGPGSEPATSGSET PGTSESATPESGPGSPAGSPTSTEEGSPAGSPTSTEEGTSTEPSEGSAPGTSESATPESGPGTSESATPES GPGTSESATPESGPGSEPATSGSETPGSEPATSGSETPGSPAGSPTSTEEGTSTEPSEGSAPGTSTEPSEG SAPGGSAPLFGRNDNHEPLELGGGATSGSETPGTDIQMTQSPSSLSASVGDRVTITCRASQDVNTAVAWYQ QKPGKAPKLLIYSASFLYSGVPSRFSGSRSGTDFTLTISSLQPEDFATYYCQQHYTTPPTFGQGTKVEIKG |

TABLE D-continued

Exemplary amino acid sequences of polypeptides

| SEQ ID NO. | Amino Acid Sequences |
|---|---|
|  | ATPPETGAETESPGETTGGSAESEPPGEGEVQLVESGGGLVQPGGSLRLSCAASGFNIKDTYIHWVRQAPG<br>KGLEWVARIYPTNGYTRYADSVKGRFTISADTSKNTAYLQMNSLRAEDTAVYYCSRWGGDGFYAMDYWGQG<br>TLVTVSSGGGSELVVTQEPSLTVSPGGTVTLTCRSSTGAVTTSNYANWVQQKPGQAPRGLIGGTNKRAPGT<br>PARFSGSSLGGSAALTLSGVQPEDEAEYYCALWYSNLWVFGGGTKLTVLGATPPETGAETESPGETTGGSA<br>ESEPPGEGEVQLQESGGGLVQPGGSLKLSCAASGFTFNTYAMNWVRQAPGKGLEWVARIRSKYNNYATYYA<br>DSVKDRFTISRDDSKNTAYLQMNNLKTEDTAVYYCVRHGNFGNSYVSWFAYWGQGTLVTVSSGTAEAASAS<br>GLFGRNDHEPLELGGGPGSPAGSPTSTEEGTSESATPESGPGSEPATSGSETPGTSESATPESGPGTSTE<br>PSEGSAPGTSTEPSEGSAPGTSTEPSEGSAPGTSTEPSEGSAPGTSTEPSEGSAPGSPA<br>GSPTSTEEGTSTEPSEGSAPGTSESATPESGPGSEPATSGSETPGTSESATPESGPGSEPATSGSETPGTS<br>ESATPESGPGTSTEPSEGSAPGTSESATPESGPGSPAGSPTSTEEGSPAGSPTSTEEGSPAGSPTSTEEGT<br>SESATPESGPGTSTEPSEGSAPGTSESATPESGPGSEPATSGSETPGTSESATPESGPGSEPATSGSETPG<br>TSESATPESGPGTSTEPSEGSAPGSPAGSPTSTEEGTSESATPESGPGSEPATSGSETPGTSESATPESGP<br>GSPAGSPTSTEEGSPAGSPTSTEEGTSTEPSEGSAPGTSESATPESGPGTSESATPESGPGTSESATPESG<br>PGSEPATSGSETPGSEPATSGSETPGSPAGSPTSTEEGTSTEPSEGSAPGTESTPSEGSAPGSEPATSGSE<br>TPGTSESATPESGPGTSTEPSEGSAPG |
| 16 | ASSPAGSPTSTESGTSESATPESGPGTSTEPSEGSAPGTSESATPESGPGSEPATSGSETPGTSESATPES<br>GPGSTPAESGSETPGTSESATPESGPGTSTEPSEGSAPGSPAGSPTSTEEGTSESATPESGPGSEPATSGS<br>ETPGTSESATPESGPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEPSEGSAPGTSTEPS<br>EGSAPGGSAPRTGRTGESANETPAGLGGPATSGSETPGTEIVLTQSPATLSLSPGERATLSCKASQDVSIG<br>VAWYQQKPGQAPRLLIYSASYRYSGVPARFSGSGSGTDFTLTISSLEPEDFAVYYCQQYYIYPYTFGQGTK<br>VEIKGATPPETGAETESPGETTGGSAESEPPGEGQVQLVQSGVEVKKPGASVKVSCKASGFTFTDYTMDWV<br>RQAPGQGLEWMADVNPNSGGSIYNQRFKGRVTLTTDSSTTTAYMELKSLQFDDTAVYYCARNLGPSFYFDY<br>WGQGTLVTVSSGGGSELVVTQEPSLTVPGGTVTLTCRSSNGAVTSSNYANWVQQKPGQAPRGLIGGTNKR<br>APGTPARFSGSLLGGKAALTLSGVQPEDEAVYYCALWYPNLWVFGGGTKLTVLGATPPETGAETESPGETT<br>GGSAESEPPGEGEVQLLESGGGIVQPGGSLKLSCAASGFTFNTYAMNWVRQAPGKGLEWVARIRSKYNNYA<br>TYYADSVKDRFTISRDDSKNTVYLQMNNLKTEDTAVYYCVRHENFGNSYVSWFAHWGQGTLVTVSSGTAEA<br>ASASGRTGRTGESANETPAGLGGPGSETPGSPAGSPTSTEEGTSESATPESGPGTSTEPSEGSAPGTSTEP<br>SEGSAPGSPAGSPTSTEEGTSTEPSEGSAPGTSTEPSEGSAPGTSESATPESGPGTSTEPSEGSAPGTSES<br>ATPESGPGSEPATSGSETPGTSTEPSEGSAPGTSTEPSEGSAPGTSESATPESGPGTSESATPESGPGSPA<br>GSPTSTEEGTSESATPESGPGSEPATSGSETPGTSESATPESGPGTSTEPSEGSAPGTSTEPSEGSAPGTS<br>TEPSEGSAPGTSTEPSEGSAPGTSTEPSEGSAPGTSTEEGTSTEPSEGSAPGT<br>SESATPESGPGSEPATSGSETPGTSESATPESGPGSEPATSGSETPGTSESATPESGPGTSTEPSEGSAPG<br>TSESATPESGPGSPAGSPTSTEEGSPAGSPTSTEEGSPAGSPTSTEEGTSESATPESGPGTSTEPSEGSAP<br>GTSESATPESGPGSEPATSGSTETGTSESATPESGPGSEPATSGSETPGTSESATPESGPGTSTEPSEGSA<br>PGSPAGSPTSTEEGTSESATPESGPGSEPATS |
| 17 | ASSPAGSPTSTESGTSESATPESGPGTSTEPSEGSAPGTSESATPESGPGSEPATSGSETPGTSESATPES<br>GPGSTPAESGSETPGTSESATPESGPGTSTEPSEGSAPGSPAGSPTSTEEGTSESATPESGPGSEPATSGS<br>ETPGTSESATPESGPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEPSEGSAPGTSTEPS<br>EGSAPGGSAPGAGRTDNHEPLELGAAATSGSETPGTDIQMTQSPSSLSASVGDRVTITCKASQDVSIGVAW<br>YQQKPGKAPKLLIYSASYRYTGVPSRFSGSGSGTDFTLTISSLQPEDFATYYCQQYYTYPYTFGQGTKVEI<br>KGATPPETGAETESPGETTGGSAESEPPGEGEVQLVESGGGLVQPGGSLRLSCAASGFTFDYWGQRVQA<br>PGKGLEWVADVNPNSGGSIYNQRFKGRFTLSVDRSKNTLYLQMNSLRAEDTAVYYCARNLGPSFYFDYWGQ<br>GTLVTVSSGGGSELVVTQEPSLTVSPGGTVTLTCRSSTGAVTTSNYANWVQQKPGQAPRGLIGGTNKRAPG<br>TPARFSGSLLGGKAALTLSGVQPEDEAEYYCALWYSNLWVFGGGTKLTVLGATPPETGAETESPGETTGGS<br>AESEPPGEGEVQLLESGGGLVQPGGSLKLSCAASGFTFNTYAMNWVRQAPGKGLEWVARIRSKYNNYATYY<br>ADSVKDRFTISRDDSKNTAYLQMNNLKTEDTAVYYCVRHGNFGNSYVSWFAYWGQGTLVTVSSGTAEAASA<br>SGGAGRTDNHEPLELGAATPESGPGTSESATPESGPGSPAGSPTSTEEGTSESATPESGPGSEPATSGSET<br>PGTSESATPESGPGTSTEPSEGSAPGTSTEPSEGSAPGTSTEPSEGSAPGTSTEPSEGS<br>APGTSTEPSEGSAPGSPAGSPTSTEEGTSTEPSEGSAPGTSESATPESGPGSEPATSGSETPGTSESATPE<br>SGPGSEPATSGSETPGTSESATPESGPGTSTEPSEGSAPGTSESATPESGPGSPAGSPTSTEEGSPAGSPT<br>STEEGSPAGSPTSTEEGTSESATPESGPGTSTEPSEGSAPGTSESATPESGPGSEPATSGSETPGTSESAT<br>PESGPGSEPATSGSETPGTSESATPESGPGTSTEPSEGSAPGSPAGSPTSTEEGTSESATPESGPGSEPAT<br>SGSETPGTSESATPESGPGSPAGSPTSTEEGSPAGSPTSTEEGTSTEPSEGSAPGTSESATPESGPGTSES<br>ATPESGPGTSESATPESGPGSEPATSGSETPGSESATSGSETPGSPAGSPTSTEEGTSTEPSEGSAPGTST<br>EPSEGSAPGSEPATSGSETPGTSESA |
| 18 | GSPAGSPTSTEEGTSESATPESGPGTSTEPSEGSAPGSPAGSPTSTEEGTSTEPSEGSAPGTSTEPSEGSA<br>PGTSESATPESGPGSESATSGSETPGSEPATSGSETPGSPAGSPTSTEEGTSESATPESGPGTSTEPSEGS<br>APGTSTEPSEGSAPGSPAGSPTSTEEGTSTEPSEGSAPGTSTEPSEGSAPGTSESATPESGPGTSTEPSEG<br>SAPGTSESATPESGPGSEPATSGSETPGTSTEPSEGSAPGTSTEPSEGSAPGTSESATPESGPGTSESATP<br>ESGPGSPAGSPTSTEEGTSESATPESGPGSEPATSGSETPGTSESATPESGPGTSTEPSEGSAPGTSTEPS<br>EGSAPGTSTEPSEGSAPGTSTEPSEGSAPGTSTEPSEGSAPGSPAGSPTSTEEGTSTEP<br>SEGSAPGTSESATPESGPGSEPATSGSETPGTSESATPESGPGSEPATSGSETPGTSESATPESGPGTSTE<br>PSEGSAPGTSESATPESGPGSPAGSPTSTEEGSPAGSPTSTEEGSPAGSPTSTEEGTSESATPESGPGTST<br>EPSEGSAPGTSESATPESGPGSEPATSGSETPGTSESATPESGPGSEPATSGSETPGTSESATPESGPGTS<br>TEPSEGSAPGSPAGSPTSTEEGTSESATPESGPGSEPATSGSETPGSPAGSPTSTEEGS<br>PAGSPTSTEEGTSTEPSEGSAPGTSESATPESGPGTSESATPESGPGTSESATPESGPGSEPATSGSETPG<br>SEPATSGSETPGSPAGSPTSTEEGTSTEPSEGSAPGTSTEPSEGSAPGSEPATSGSETPGTSESATPESGP<br>GTSTEPSEGSAPESGRAANTGPPTLTAPATSGSETPGTDIQMTQSPSSLSASVGDRVTITCRASQDVNTAV<br>AWYQQKPGKAPKLLIYSASFLYSGVPSRFSGSRSGTDFTLTISSLQPEDFATYYCQQHYTTPPTFGQGTKV<br>EIKGATPPETGAETESPGETTGGSAESEPPGEGEVQLVESGGGLVQPGGSLRLSCAASGFNIKDTYIHWVR |

TABLE D-continued

Exemplary amino acid sequences of polypeptides

| SEQ ID NO. | Amino Acid Sequences |
|---|---|
| | QAPGKGLEWVARIYPTNGYTRYADSVKGRFTISADTSKNTAYLQMNSLRAEDTAVYYCSRWGGDGFYAMDY WGQGTLVTVSSGGGSELVVTQEPSLTVSPGGTVTLTCRSSNGAVTSSNYANWVQQKPGQAPRGLIGGTNKR APGTPARFSGSSLGGKAALTLSGVQPEDEAVYYCALWYPNLWVFGGGTKLTVLGATPPETGAETESPGETT GGSAESEPPGEGEVQLQESGGGIVQPGGSLKLSCAASGFTFNTYAMNWVRQAPGKGLEWVARIRSKYNNYA TYYADSVKDRFTISRDDSKNTVYLQMNNLKTEDTAVYYCVRHENFGNSYVSWFAHWGQGTLVTVSSGTAEA ASASGESGRAANTGPPTLTAPPGSPAGSPTSTEEGTSESATPESGPGTSTEPSEGSAPGSPAGSPTSTEEG TSTEPSEGSAPGTSTEPSEGSAPGTSESATPESGPGSEPATSGSETPGSEPATSGSETPGSPAGSPTSTEE GTSESATPESGPGTSTEPSEGSAPGTSTEPSEGSAPGSPAGSPTSTEEGTSTEPSEGSAPGTSTEPSEGSA PGTSESATPESGPGTSTEPSEGSAPGTSESATPESGPGSEPATSGSETPGTSTEPSEGSAPGTSTEPSEGS APGTSESATPESGPGTSESATPESGPGSPAGSPTSTEEGTSESATPESGPGSEPATSGSETPGTSESATPE SGPGTSTEPSEGSAPGTSTEPSEGSAPGTSTEPSEGSAPGTSTEPSEGSAPGTSTEPSEGSAPGTSTEPSE GSAPGSPAGSPTSTEEGTSTEPSEGSAPGTSESATPESGPGSEPATSGSETPGTSESATPESGPGSEPATS GSETPGTSESATPESGPGTSTEPSEGSAPGTSESATPESGPGSPAGSPTSTEEGSPAGSPTSTEEGSPAGS PTSTEEGTSESATPESGPGTSTEPSEGSAPGTSESATPESGPGSEPATSGSETPGTSESATPESGPGSEPA TSGSETPGTSESATPESGPGTSTEPSEGSAPGSPAGSPTSTEEGTSESATPESGPGSEPATSGSETPGTSE SATPESGPGSPAGSPTSTEEGSPAGSPTSTEEGTSTEPSEGSAPGTSESATPESGPGTSESATPESGPGTS ESATPESGPGSEPATSGSETPGSEPATSGSETPGSPAGSPTSTEEGTSTEPSEGSAPGTSESTPSEGSAPGS EPATSGSETPGTSESATPESGPGTSTEPSEGSAPG |
| 19 | ASSPAGSPTSTESGTSESATPESGPGTSTEPSEGSAPGTSESATPESGPGSEPATSGSETPGTSESATPES GPGSTPAESGSETPGTSESATPESGPGTSTEPSEGSAPGSPAGSPTSTEEGTSESATPESGPGSEPATSGS ETPGTSESATPESGPGSPAGSPTSTEEGSPAGSPTSTEEGTSTEPSEGSAPGTSESATPESGPGTSESATP ESGPGTSESATPESGPGSEPATSGSETPGSEPATSGSETPGSPAGSPTSTEEGTSTEPSEGSAPGTSTEPS EGSAPGSAPASGRSTNAGPPGLTGPATSGSETPGTDIQMTQSPSSLSASVGDRVTITCRASQDVNTAVAW YQQKPGKAPKLLIYSASFLYSGVPSRFSGSRSGTDFTLTISSLQPEDFATYYCQQHYTTPPTFGQGTKVEI KGATPPETGAETESPGETTGGSAESEPPGEGEVQLVESGGGLVQPGGSLRLSCAASGFNIKDTYIHWVRQA PGKGLEWVARIYPTNGYTRYADSVKGRFTISADTSKNTAYLQMNSLRAEDTAVYYCSRWGGDGFYAMDYWG QGTLVTVSSGGGSELVVTQEPSLTVSPGGTVTLTCRSSTGAVTTSNYANWVQQKPGQAPRGLIGGTNKRAP GTPARFSGSLLGGKAALTLSGVQPEDEAEYYCALWYSNLWVFGGGTKLTVLGATPPETGAETESPGETTGG SAESEPPGEGEVQLLESGGGLVQPGGSLKLSCAASGFTFNTYAMNWVRQAPGKGLEWVARIRSKYNNYATY YADSVKDRFTISRDDSKNTAYLQMNNLKTEDTAVYYCVRHGNFGNSYVSWFAYWGQGTLVTVSSGTAEAAS ASGAGSRSTNAGPPGLTGPPGSPAGSPTSTEEGTSESATPESGPGSEPATSGSETPGTSESATPESGPGTS TEPSEGSAPGTSTEPSEGSAPGTSTEPSEGSAPGTSTEPSEGSAPGTSTEPSEGSAPGS PAGSPTSTEEGTSTEPSEGSAPGTSESATPESGPGSEPATSGSETPGTSESATPESGPGSEPATSGSETPG TSESATPESGPGTSTEPSEGSAPGTSESATPESGPGSPAGSPTSTEEGSPAGSPTSTEEGSPAGSPTSTEE GTSESATPESGPGTSTEPSEGSAPGTSESATPESGPGSEPATSGSETPGTSESATPESGPGSEPATSGSET PGTSESATPESGPGTSTEPSEGSAPGSPAGSPTSTEEGTSESATPESGPGSEPATSGSETPGTSESATPES GPGSPAGSPTSTEEGSPAGSPTSTEEGTSTEPSEGSAPGTSESATPESGPGTSESATPESGPGTSESATPE SGPGSEPATSGSETPGSEPATSGSETPGSPAGSPTSTEEGTSTEPSEGSAPGTSESTPSEGSAPGSEPATSG SETPGTSESATPESGPGTSTEPSEGSAPG |
| 20 | SAGSPSPAGSPTSTEEGTSESATPESGPGTSTEPSEGSAPGSPAGSPTSTEEGTSTEPSEGSAPGTSTEP SEGSAPGTSESATPESGPGSTPAESGSETPGSEPATSGSETPGSPAGSPTSTEEGTSESATPESGPGTSTE PSEGSAPGTSTEPSEGSAPGSPAGSPTSTEEGTSTEPSEGSAPGTSTEPSEGSAPGTSESATPESGPGTST EPSEGSAPGTSESATPESGPGSEPATSGSETPGTSTEPSEGSAPGTSESATPESGPGT SESATPESGPGSPAGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAPGTSTEPSEGSAPGSPAGSPTSTEE GTSTEPSEGSAPGTSESATPESGPGSEPATSGSETPGTSESATPESGPGSEPATSGSETPGTSESATPESG PGTSTEPSEGSAPGTSESATPESGPGSPAGSPTSTEEGTSESATPESGPGSPAGSPTSTEEGTSESATPES GPGTSTEPSEGSAPGTSESATPESGPGSEPATSGSETPGTSESATPESGPGSEPATSGSETPGTSESATPE SGPGTSTEPSEGSAPGSPAGSPTSTEEGTSESATPESGPGSEPATSGSETPGTSESATPESGPGSPAGSPT STEEGSPAGSPTSTEEGTSTEPSEGSAPGTSESATPESGPGTSESATPESGPGTSESATPESGPGSEPATS GSETPGSEPATSGSETPGSPAGSPTSTEEGTSTEPSEGSAPGTSESAPGSEPATSGSETPGTSESA TPESGPGTSTEPSEGSAPGSPAGSPTSTEEGTSESATPESGPGTSTEPSEGSAPGSPAGSPTSTEEGTSTE PSEGSAPGTSTEPSEGSAPGTSESATPESGPGSEPATSGSETPGSEPATSGSETPGSPAGSPTSTEEGTSE SATPESGPGTSTEPSEGSAPGTSTEPSEGSAPGSPAGSPTSTEEGTSTEPSEGSAPGTSTEPSEGSAPGTS ESATPESGPGTSTEPSEGSAPGTSESATPESGPGSEPATSGSETPGTSTEPSEGSAPGTSTEPSEGSAPGT SESATPESGPGTESASLFGRNDNHEPLELGGGATSGSETPGTEIVLTQSPATLSLSPGERATLSCKASQDV SIGVAWYQQKPGQAPRLLIYSASYRYSGVPARFSGSGSGTDFTLTISSLEPEDFAVYYCQQYYTYPYTFGQ GTKVEIKGATPPETGAETESPGETTGGSAESEPPGEGQVQLVQSGVEVKKPGASVKVSCKASGFTFTDYTM DWVRQAPGQGLEWMADVNPNSGGSIYNQRFKGRVTLTTDSSTTTAYMELKSLQFDDTAVYYCARNLGPSFY FDYWGQGTLVTVSSGGGSELVVTQEPSLTVSPGGTVTLTCRSSNGAVTSSNYANWVQQKPGQAPRGLIGGT NKRAPGTPARFSGSLLGGKAALTLSGVQPEDEAVYYCALWYPNLWFGGGTKLTVLGATPPETGAETESPG ETTGGSAESEPPGEGEVQLLESGGGIVQPGGSLKLSCAASGFTFNTYAMNWVRQAPGKGLEWVARIRSKYN NYATYYADSVKDRFTISRDDSKNTVYLQMNNLKTEDTAVYYCVRHENFGNSYVSWFAHWGQGTLVTVSSGT AEAASASGLFGRNDNHEPLELGGGESAPGTSTEPSEGSAPGTSESATPESGPGTSTEPSEGSAPGTSESA TPESGPGSEPATSGSETPGTSTEPSEGSAPGTSTEPSEGSAPGTSESATPESGPGTSESATPESGPGSPAG SPTSTEEGTSESATPESGPGSEPATSGSETPGTSESATPESGPGTSTEPSEGSAPGTSTEPSEGSAPGTST EPSEGSAPGTSTEPSEGSAPGTSTEPSEGSAPGTSTEPSEGSAPGSPAGSPTSTEEGTSTEPSEGSAPGTS ESATPESGPGSEPATSGSETPGTSESATPESGPGSEPATSGSETPGTSESATPESGPGTSTEPSEGSAPGT SESATPESGPGSPAGSPTSTEEGSPAGSPTSTEEGSPAGSPTSTEEGTSESATPESGPGTSTEPSEGSAPG TSESATPESGPGSEPATSGSETPGTSESATPESGPGSEPATSGSETPGTSESASPESGPGTSTEPSEGSAP GSPAGSPTSTEEGTSESATPESGPGSEPATSGSETPGTSESATPESGPGSPAGSPTSTEEGSPAGSPTSTE EGTSTEPSEGSAPGTSESATPESGPGTSESAT |

TABLE D-continued

Exemplary amino acid sequences of polypeptides

| SEQ ID NO. | Amino Acid Sequences |
|---|---|
| 21 | GSPAGSPTSTEEGTSESATPESGPGTSTEPSEGSAPGSPAGSPTSTEEGTSTEPSEGSAPGTSTEPSEGSA<br>PATSESATPESGPGSEPATSGSETPGSEPATSGSETPGSPAGSPTSTEEGTSESASPESGPGTSTEPSEGS<br>APGTSTEPSEGSAPGSPAGSPTSTEEGTSTEPSEGSAPGTSTEPSEGSAPGTSESATPESGPGTSTEPSEG<br>SAPGTSESATPESGPGSEPATSGSETPGTSTEPSEGSAPGTSTEPSEGSAPGTSESATPESGPGTSESATP<br>ESGPGSPAGSPTSTEEGTSESATPESGPGSEPATSGSETPGTSESATPESGPGTSTEPSEGSAPGTSTEPS<br>EGSAPGTSTEPSEGSAPGTSTEPSEGSAPGTSTEPSEGSAPGTSTEPSEGSAPGSPAGSPTSTEEGTSTEP<br>SEGSAPGTSESATPESGPGSEPATSGSETPGTSESATPESGPGSEPATSGSETPGTSESATPESGPGTSTE<br>PSEGSAPGTSESATPESGPGSPAGSPTSTEEGSPAGSPTSTEEGTSESATPESGPGSEPATSGSETPGTST<br>EPSEGSAPGTSESATPESGPGSEPATSGSETPGTSESATPESGPGSEPATSGSETPGTSESATPESGPGTS<br>TEPSEGSAPGSPAGSPTSTEEGTSESATPESGPGSEPATSGSETPGTSESATPESGPGSPAGSPTSTEEGS<br>PAGSPTSTEEGTSTEPSEGSAPGTSESATPESGPGTSESATPESGPGTSESATPESGPGSEPATSGSETPG<br>SEPATSGSETPGSPAGSPTSTEEGTSTEPSEGSAPGTSTEPSEGSAPGSEPATSGSETPGTSESATPESGP<br>GTSTEPSEGSAPTTGRAGEAEGATSAGATGPATSGSETPGTDIQMTQSPSSLSASVGDRVTITCRASQDVN<br>TAVAWYQQKPGKAPKLLIYSASFLYSGVPSRFSGSRSGTDFTLTISSLQPEDFATYYCQQHYTTPPTFGQG<br>TKVEIKGATPPETGAETESPGETTGGSAESEPPGEGEVQLVESGGGLVQPGGSLRLSCAASGFNIKDTYIH<br>WVRQAPGKGLEWVARIYPTNGYTRYADSVKGRFTISADTSKNTAYLQMNSLRAEDTAVYYCSRWGGDGFYA<br>MDYWGQGTLVTVSSGGGSELVVTQEPSLTVSPGGTVTLTCRSSTGAVTTSNYANWVQQKPGQAPRGLIGGT<br>NKRAPGTPARFSGSLLGGKAALTLSGVQPEDEAEYYCALWYSNLWVFGGGTKLTVLGATPPETGAETESPG<br>ETTGGSAESEPPGEGEVQLLESGGGLVQPGGSLKLSCAASGFTFNTYAMNWVRQAPGKGLEWVARIRSKYN<br>NYATYYADSVKDRFTISRDDSKNTAYLQMNNLKTEDTAVYYCVRHGNFGNSYVSWFAYWGQGTLVTVSSGT<br>AEAASASGTTGRAGEAEGATSAGATGPGSETPGSPAGSPTSTEEGTSESATPESGPGTSTEPSEGSAPGTS<br>TEPSEGSAPGSPAGSPTSTEEGTSTEPSEGSAPGTSTEPSEGSAPGTSESATPESGPGTSTEPSEGSAPGT<br>SESATPESGPGSEPATSGSETPGTSTEPSEGSAPGTSTEPSEGSAPGTSESATPESGPGTSESATPESGPG<br>SPAGSPTSTEEGTSESATPESGPGSEPATSGSETPGTSTEPSEGSAPGTSTEPSEGSAP<br>GTSTEPSEGSAPGTSTEPSEGSAPGTSTEPSEGSAPGTSTEPSEGSAPGSPAGSPTSTEEGTSTEPSEGSA<br>PGTSESATPESGPGSEPATSGSETPGTSESATPESGPGSEPATSGSETPGTSESATPESGPGTSTEPSEGS<br>APGTSESATPESGPGSPAGSPTSTEEGSPAGSPTSTEEGSPAGSPTSTEEGTSESATPESGPGTSTEPSEG<br>SAPGTSESATPESGPGSEPATSGSTETPGTSESATPESGPGSEPATSGSETPGTSESATPESGPGTSTEPSE<br>GSAPGSPAGSPTSTEEGTSESATPESGPGSEPATS |
| 22 | ASSPAGSPTSTESGTSESATPESGPGTETEPSEGSAPGTSESATPESGPGSEPATSGSETPGTSESATPES<br>GPGSTPAESGSETPGTSESATPESGPGTSTEPSEGSAPGSPAGSPTSTEEGTSESATPESGPGESPATSGS<br>TPEGTSESATPESGPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEPSEGSAPGTSTEPS<br>EGSAPGGSAPASGRGTNAGPAGLTGPATSGSETPGTDIQMTQSPSSLSASVGDRVTITCKASQDVSIGVAW<br>YQQKPGKAPKLLIYSASYRYTGVPSRFSGSGSGTDFTLTISSLQPEDFATYYCQQYYIYPYTFGQGTKVEI<br>KGATPPETGAETESPGETTGGSAESEPPGEGEVQLVESGGGLVQPGGSLRLSCAASGFTFTDYTMDWVRQA<br>PGKGLEWVADVNPNSGGSIYNQRFKGRFTLSVDRSKNTLYLQMNSLRAEDTAVYYCARNLGPSFYFDYWGQ<br>GTLVTVSSGGGSELVVTQEPSLTVSPGGTVTLTCRSSNGAVTSSNYANWVQQKPGQAPRGLIGGTNKRAPG<br>TPARFSGSSLGGKAALTLSGVQPEDEAVYYCALWYPNLWVFGGGTKLTVLGATPPETGAETESPGETTGGS<br>AESEPPGEGEVQLQESGGGIVQPGGSLKLSCAASGFTFNTYAMNWVRQAPGKGLEWVARIRSKYNNYATYY<br>ADSVKDRFTISRDDSKNTVYLQMNNLKTEDTAVYYCVRHENFGNSYVSWFAHWGQGTLVTVSSGTAEAASA<br>SGASGRGTNAGPAGLTGPPGSPAGSPTSTEEGTSESATPESGPGTSTEPSEGSAPGSPAGSPTSTEEGTST<br>EPSEGSAPGTSTEPSEGSAPGTSESATPESGPGSEPATSGSETPGSEPATSGSETPGSPAGSPTSTEEGTS<br>ESATPESGPGTSTEPSEGSAPGTSTEPSEGSAPGSPAGSPTSTEEGTSTEPSEGSAPGTSTEPSEGSAPGT<br>SESATPESGPGTSTEPSEGSAPGTSESATPESGPGSEPATSGSETPGTSTEPSEGSAPGTSTEPSEGSAPG<br>TSESATPESGPGTSESATPESGPGSPAGSPTSTEEGTSESATPESGPGSEPATSGSETPGTSESATPESGP<br>GTSTEPSEGSAPGTSTEPSEGSAPGTSTEPSEGSAPGTSTEPSEGSAPGTSTEPSEGSAPGTSTEPSEGSA<br>PGSPAGSPTSTEEGTSTEPSEGSAPGTSESATPESGPGSEPATSGSETPGTSESATPESGPGSEPATSGSE<br>TPGTSESATPESGPGTSTEPSEGSAPGTSESATPESGPGSPAGSPTSTEEGSPAGSPTSTEEGSPAGSPTS<br>TEEGTSESATPESGPGTSTEPSEGSAPGTSESATPESGPGSEPATSGSETPGTSESATPESGPGSEPATSG<br>SETPGTSESATPESGPGTSTEPSEGSAPGSPAGSPTSTEEGTSESATPESGPGSEPATSGSETPGTSESAT<br>PESGPGSPAGSPTSTEEGSPAGSPTSTEEGTSTEPSEGSAPGTSESATPESGPGTSESATPESGPGTSESA<br>TPESGPGSEPATSGSETPGSEPATSGSETPGSPAGSPTSTEEGTSTEPSEGSAPGTSESTPSEGSAPGSEPA<br>TSGSETPGTSESATPESGPGTSTEPSEGSAPG |
| 23 | ASSPAGSPTSTESGTSESATPESGPGTSTEPSEGSAPGTSESATPESGPGSEPATSGSETPGTSESATPES<br>GPGSTPAESGSETPGTSESATPESGPGTSTEPSEGSAPGSPAGSPTSTEEGTSESATPESGPGEEPATSGS<br>TPEGTSESATPESGPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEPSEGSAPGTSTEPS<br>EGSAPGGSAPGAGRTDNHEPLELGAAATSGSETPGTDIQMTQSPSSLSASVGDRVTITCRASQDVNTAVAW<br>YQQKPGKAPKLLIYSASFLYSGVPSRFSGSRSGTDFTLTISSLQPEDFATYYCQQHYTTPPTFGQGTKVEI<br>KGATPPETGAETESPGETTGGSAESEPPGEGEVQLVESGGGLVQPGGSLRLSCAASGFNIKDTYIHWVRQA<br>PGKGLEWVARIYPTNGYTRYADSVKGRFTISADTSKNTAYLQMNSLRAEDTAVYYCSRWGGDGFYAMDYWG<br>QGTLVTVSSGGGSELVVTQEPSLTVSPGGTVTLTCRSSTGAVTTSNYANWVQQKPGQAPRGLIGGTNKRAP<br>GTPARFSGSLLGGSAALTLSGVQPEDEAEYYCALWYSNLWVFGGGTKLTVLGATPPETGAETESPGETTGG<br>SAESEPPGEGEVQLQESGGGLVQPGGSLKLSCAASGFTFNTYAMNWVRQAPGKGLEWVARIRSKYNNYATY<br>YADSVKDRFTISRDDSKNTAYLQMNNLKTEDTAVYYCVRHGNFGNSYVSWFAYWGQGTLVTVSSGTAEAAS<br>ASGGAGRTDNHEPLELGAAPGSPAGSPTSTEEGTSESATPESGPGTSTEPSEGSAPGSPAGSPTSTEEGTS<br>TEPSEGSAPGTSTEPSEGSAPGTSESATPESGPGSEPATSGSETPGSPAGSPTSTEEGT<br>SESATPESGPGTSTEPSEGSAPGTSTEPSEGSAPGSPAGSPTSTEEGTSTEPSEGSAPGTSTEPSEGSAPG<br>TSESATPESGPGTSTEPSEGSAPGTSESATPESGPGSEPATSGSETPGTSTEPSEGSAPGTSTEPSEGSAP<br>GTSESATPESGPGTSESATPESGPGSPAGSPTSTEEGTSESATPESGPGSEPATSGSETPGTSESATPESG<br>PGTSTEPSEGSAPGTSTEPSEGSAPGTSTEPSEGSAPGTSTEPSEGSAPGTSTEPSEGSAPGTSTEPSEGS<br>APGSPAGSPTSTEEGTSTEPSEGSAPGTSESATPESGPGSEPATSGSETPGTSESATPESGPGSEPATSGS |

TABLE D-continued

Exemplary amino acid sequences of polypeptides

| SEQ ID NO. | Amino Acid Sequences |
|---|---|
|  | ETPGTSESATPESGPGTSTEPSEGSAPGTSESATPESGPGSPAGSPTSTEEGSPAGSPTSTEEGSPAGSPT<br>STEEGTSESATPESGPGTSTEPSEGSAPGTSESATPESGPGSEPATSGSETPGTSESATPESGPGSEPATS<br>GSETPGTSESATPESGPGTSTEPSEGSAPGSPAGSPTSTEEGTSESATPESGPGSEPATSGSETPGTSESA<br>TPESGPGSPAGSPTSTEEGSPAGSPTSTEEGTSTEPSEGSAPGTSESATPESGPGTSESATPESGPGftab<br>TSESATPESGPGSEPATSGPTESGSEPATSGSETPGSPAGSPTSTEEGTSTEPSEGSAPGTESTPSEGSAP<br>GSEPATSGSETPGTSESATPESGPGTSTEPSEGSAPGEPEA |
| 24 | SAGSPGSPAGSPTSTEEGTSESATPESGPGTSTEPSEGSAPGSPAGSPTSTEEGTSTEPSEGSAPGTSTEP<br>SEGSAPGTSESATPESGPGSTPAESGSETPGSEPATSGSETPGSPAGSPTSTEEGTSESATPESGPGTSTE<br>PSEGSAPGTSTEPSEGSAPGSPAGSPTSTEEGTSTEPSEGSAPGTSTEPSEGSAPGTSESATPESGPGTST<br>EPSEGSAPGTSESATPESGPGSEPATSGSTETPGTSTEPSEGSAPGTSTEPSEGSAPGTSESATPESGPGT<br>SESATPESGPGSPAGSPTSTEEGTSESATPESGPGSEPATSGSETPGTSESATPESGPGTSTEPSEGSAPG<br>TSTEPSEGSAPGTSTEPSEGSAPGTSTEPSEGSAPGTSTEPSEGSAPGTSTEPSEGSAPGSPAGSPTSTEE<br>GTSTEPSEGSAPGTSESATPESGPGSEPATSGSETPGTSESATPESGPGSEPATSGSETPGTSESATPESG<br>PGTSTEPSEGSAPGTSESATPESGPGSPAGSPTSTEEGSPAGSPTSTEEGSPAGSPTSTEEGTSESATPES<br>GPGTSTEPSEGSAPGTSESATPESGPGSEPATSGSETPGTSESATPE<br>SGPGTSTEPSEGSAPGSPAGSPTSTEEGTSESATPESGPGSEPATSGSETPGTSESATPESGPGSPAGSPT<br>STEEGSPAGSPTSTEEGTSTEPSEGSAPGTSESATPESGPGTSESATPESGPGTSESATPESGPGSEPATS<br>GSETPGSEPATSGSETPGSPAGSPTSTEEGTSTEPSEGSAPGTSTEPSEGSAPGSEPATSGSETPGTSESA<br>TPESGPGTSTEPSEGSAPGSPAGSPTSTEEGTSESATPESGPGSPAGSPAGSPTSTEEGTSTE<br>PSEGSAPGTSTEPSEGSAPGTSESATPESGPGSEPATSGSETPGSEPATSGSETPGSPAGSPTSTEEGTSE<br>SATPESGPGTSTEPSEGSAPGTSTEPSEGSAPGSPAGSPTSTEEGTSTEPSEGSAPGTSTEPSEGSAPGTS<br>ESATPESGPGTSTEPSEGSAPGTSESATPESGPGSEPATSGSETPGTSTEPSEGSAPGTSTEPSEGSAPGT<br>SESATPESGPGTESASASGRAANETPPGLTGAATSGSETPGTEIVLTQSPATLSLSPGERATLSCKASQDV<br>SIGVAWYQQKPGQAPRLLIYSASYRYSGVPARFSGSGSGTDFTLTISSLEPEDFAVYYCQQYTYPYTFGQ<br>GTKVEIKGATPPETGAETESPGETTGGSAESEPPGEGQVQLVQSGVEVKKPGASVKVSCKASGFTFTDYTM<br>DWVRQAPGQGLEWMADVNPNSGGSIYNQRFKGRVTLTTDSSTTTAYMELKSLQFDDTAVYYCARNLGPSFY<br>FDYWGQGTLVTVSSGGGGSELVVTQEPSLTVSPGGTVTLTCRSSNGAVTSSNYANWVQQKPGQAPRGLIGGT<br>NKRAPGTPARFSGSLLGGKAALTLSGVQPEDEAVYYCALWYPNLWVFGGGTKLTVLGATPPETGAETESPG<br>ETTGGSAESEPPGEGEVQLLESGGGIVQPGGSLKLSCAASGFTFNTYAMNWVRQAPGKGLEWVARIRSKYN<br>NYATYYADSVKDRFTISRDDSKNTVYLQMNNLKTEDTAVYYCVRHENFGNSYVSWFAHWGQGTLVTVSSGT<br>AEAASASGASGRAANETPPGLTGAGSETPGSPAGSPTSTEEGTSESATPESGPGTSTEPSEGSAPGTSTEP<br>SEGSAPGSPAGSPTSTEEGTSTEPSEGSAPGTSTEPSEGSAPGTSTEPSEGSAPGTSTEPSEGSAPGTSES<br>ATPESGPGSEPATSGSETPGTSTEPSEGSAPGTSTEPSEGSAPGTSESATPESGPGTSESATPESGPGSPA<br>GSPTSTEEGTSESATPESGPGSEPATSGSETPGTSESATPESGPGTSTEPSEGSAPGTSTEPSEGSAPGTS<br>TEPSEGSAPGTSTEPSEGSAPGTSTEPSEGSAPGTSTEPSEGSAPGSPAGSPTSTEEGTSTEPSEGSAPGT<br>SESATPESGPGSEPATSGSETPGTSESATPESGPGSEPATSGSETPGTSESATPESGPGTSTEPSEGSAPG<br>TSESATPESGPGSPAGSPTSTEEGSPAGSPTSTEEGSPAGSPTSTEEGTSESATPESGPGTSTEPSEGSAP<br>GTSESATPESGPGSEPATSGSTETGTSESATPESGPGSEPATSGSETPGTSESATPESGPGTSTEPSEGSA<br>PGSPAGSPTSTEEGTSESATPESGPGSEPATS |
| 25 | GSPAGSPTSTEEGTSESATPESGPGTSTEPSEGSAPGSPAGSPTSTEEGTSTEPSEGSAPGTSTEPSEGSA<br>PATSESATPESGPGSEPATSGSETPGSEPATSGSETPGSPAGSPTSTEEGTSESASPESGPGTSTEPSEGS<br>APGTSTEPSEGSAPGSPAGSPTSTEEGTSTEPSEGSAPGTSTEPSEGSAPGTSESATPESGPGTSTEPSEG<br>SAPGTSESATPESGPGSEPATSGSETPGTSTEPSEGSAPGTSTEPSEGSAPGTSESATPESGPGTSESATP<br>ESGPGSPAGSPTSTEEGTSESATPESGPGSEPATSGSETPGTSESATPESGPGTSTEPSEGSAPGTSTEPS<br>EGSAPGTSTEPSEGSAPGTSTEPSEGSAPGTSTEPSEGSAPGTSTEPSEGSAPGSPAGSPTSTEEGTSTEP<br>SEGSAPGTSESATPESGPGSEPATSGSETPGTSESATPESGPGSEPATSGSETPGTSESATPESGPGTSTE<br>PSEGSAPGTSESATPESGPGSPAGSPTSTEEGSPAGSPTSTEEGSPAGSPTSTEEGTSESATPESGPGTST<br>EPSEGSAPGTSESATPESGPGSEPATSGSETPGTSESATPESGPGSEPATSGSETPGTSESATPESGPGTS<br>TEPSEGSAPGSPAGSPTSTEEGTSESATPESGPGSEPATSGSETPGTSESATPESGPGSPAGSPTSTEEGS<br>PAGSPTSTEEGTSTEPSEGSAPGTSESATPESGPGTSESATPESGPGTSESATPESGPGSEPATSGSETPG<br>SEPATSGSETPGSPAGSPTSTEEGTSTEPSEGSAPGTSTEPSEGSAPGSEPATSGSETPGTSESATPESGP<br>GTSTEPSEGSAPASGRSTNAGPPGLTGPATSGSETPGTEIVLTQSPATLSLSPGERATLSCKASQDVSIGV<br>AWYQQKPGQAPRLLIYSASYRYSGVPARFSGSGSGTDFTLTISSLEPEDFAVYYCQQYYIYPYTFGQGTKV<br>EIKGATPPETGAETESPGETTGGSAESEPPGEGQVQLVQSGVEVKKPGASVKVSCKASGFTFTDYTMDWVR<br>QAPGQGLEWMADVNPNSGGSTYNQRFKGRVTLTTDSSTTTAYMELKSLQFDDTAVYYCARNLGPSFYFDYW<br>GQGTLVTVSSGGGGSELVVTQEPSLTVSPGGTVTLTCRSSNGAVTSSNYANWVQQKPGQAPRGLIGGTNKRA<br>PGTPARFSGSSLLGGKAALTLSGVQPEDEAVYYCALWYPNLWVFGGGTKLTVLGATPPETGAETESPGETTG<br>GSAESEPPGEGEVQLQESGGGIVQPGGSLKLSCAASGFTFNTYAMNWVRQAPGKGLEWVARISKYNNYAT<br>YYADSVKDRFTISRDDSKNTVYLQMNNLKTEDTAVYYCVRHENFGNSYVSWFAHWGQGTLVTVSSGTAEEA<br>SASGASGRSTNAGPPGLTGPGSETPGSPAGSPTSTEEGTSESATPESGPGTSTEPSEGSAPGTSTEPSEGS<br>APGSPAGSPTSTEEGTSTEPSEGSAPGTSTEPSEGSAPGTSESATPESGPGTSTEPSEGSAPGTSESATPE<br>SGPGSEPATSGSETPGTSTEPSEGSAPGTSTEPSEGSAPGTSESATPESGPGTSESATPESGPGSPAGSPT<br>STEEGTSESATPESGPGSEPATSGSETPGTSESATPESGPGTSTEPSEGSAPGTSTEPSEGSAPGTSTEPS<br>EGSAPGTSTEPSEGSAPGTSTEPSEGSAPGTSTEPSEGSAPGSPAGSPTSTEEGTSTEPSEGSAPGTSESA<br>TPESGPGSEPATSGSETPGTSESATPESGPGSEPATSGSETPGTSESATPESGPGTSTEPSEGSAPGTSES<br>ATPESGPGSPAGSPTSTEEGSPAGSPTSTEEGSPAGSPTSTEEGTSESATPESGPGTSTEPSEGSAPGTSE<br>SATPESGPGSEPATSGSTETGTSESATPESGPGSEPATSGSETPGTSESATPESGPGTSTEPSEGSAPGSP<br>AGSPTSTEEGTSESATPESGPGSEPATS |
| 26 | ASSPAGSPTSTESGTSESATPESGPGTSTEPSEGSAPGTSESATPESGPGSEPATSGSETPGTSESATPES<br>GPGSTPAESGSETPGTSESATPESGPGTSTEPSEGSAPGSPAGSPTSTEEGTSESATPESGPGEEPATSGS<br>TPEGTSESATPESGPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEPSEGSAPGTSTEPS |

TABLE D-continued

Exemplary amino acid sequences of polypeptides

| SEQ ID NO. | Amino Acid Sequences |
|---|---|
| | EGSAPGGSAPRTGRTGESANETPAGLGGPATSGSETPGTEIVLTQSPATLSLSPGERATLSCKASQDVSIG
VAWYQQKPGQAPRLLIYSASYRYSGVPARFSGSGSGTDFTLTISSLEPEDFAVYYCQQYYIYPYTFGQGTK
VEIKGATPPETGAETESPGETTGGSAESEPPGEGQVQLVQSGVEVKKPGASVKVSCKASGFTFTDYTMDWV
RQAPGQGLEWMADVNPNSGGSIYNQRFKGRVTLTTDSSTTTAYMELKSLQFDDTAVYYCARNLGPSFYFDY
WGQGTLVTVSSGGGSELVVTQEPSLTVSPGGTVTLTCRSSTGAVTTSNYANWVQQKPGQAPRGLIGGTNKR
APGTPARFSGSSLGGSAALTLSGVQPEDEAEYYCALWYSNLWVFGGGTKLTVLGATPPETGAETESPGETT
GGSAESEPPGEGEVQLQESGGGLVQPGGSLKLSCAASGFTFNTYAMNWVRQAPGKGLEWVARIRSKYNNYA
TYYADSVKDRFTISRDDSKNTAYLQMNNLKTEDTAVYYCVRHGNFGNSYVSWFAYWGQGTLVTVSSGTAEA
ASASGRTGRTGESANETPAGLGGPPGSPAGSPTSEEGTSESATPESGPGSEPATSGSETPGTSESATPES
GPGTSTEPSEGSAPGTSTEPSEGSAPGTSTEPSEGSAPGTSTEPSEGSAPGTSTEPSEGSAPGTSTEPSEG
SAPGSPAGSPTSTEEGTSTEPSEGSAPGTSESATPESGPGSEPATSGSETPGTSESATPESGPGSEPATSG
SETPGTSESATPESGPGTSTEPSEGSAPGTSESATPESGPGSPAGSPTSTEEGSPAGSPTSTEEGSPAGSP
TSTEEGTSESATPESGPGTSTEPSEGSAPGTSESATPESGPGSEPATSGSETPGTSESATPESGPGSEPAT
SGSETPGTSESATPESGPGTSTEPSEGSAPGSPAGSPTSTEEGTSESATPESGPGSEPATSGSETPGTSES
ATPESGPGSPAGSPTSTEEGSPAGSPTSTEEGTSTEPSEGSAPGTSESATPESGPGTSESATPESGPGTSE
SATPESGPGSEPATSGSETPGSEPATSGSETPGSPAGSPTSTEEGTSTEPSEGSAPGTESTPSEGSAPGSE
PATSGSETPGTSESATPESGPGTSTEPSEGSAPG |
| 27 | ASSPAGSPTSTESGTSESATPESGPGTSTEPSEGSAPGTSESATPESGPGSEPATSGSETPGTSESATPES
GPGSTPAESGSETPGTSESATPESGPGTSTEPSEGSAPGSPAGSPTSTEEGTSESATPESGPGSEPATSGS
ETPGTSESATPESGPGSPAGSPTSTEEGSPAGSPTSTEEGTSTEPSEGSAPGTSESATPESGPGTSESATP
ESGPGTSESATPESGPGSEPATSGSETPGSEPATSGSETPGSPAGSPTSTEEGTSTEPSEGSAPGTSTEPS
EGSAPGGSAPLFGRNDNHEPLELGGGATSGSETPGTDIQMTQSPSSLSASVGDRVTITCKASQDVSIGVAW
YQQKPGKAPKLLIYSASYRYTGVPSRFSGSGSGTDFTLTISSLQPEDFATYYCQQYYTYPYTFGQGTKVEI
KGATPPETGAETESPGETTGGSAESEPPGEGEVQLVESGGGLVQPGGSLRLSCAASGFTFTDYTMDWVRQA
PGKGLEWVADVNPNSGGSIYNQRFKGRFTLSVDRSKNTLYLQMNSLRAEDTAVYYCARNLGPSFYFDYWGQ
GTLVTVSSGGGSELVVTQEPSLTVSPGGTVTLTCRSSTGAVTTSNYANWVQQKPGQAPRGLIGGTNKRAPG
TPARFSGSLLGGKAALTLSGVQPEDEAEYYCALWYSNLWVFGGGTKLTVLGATPPETGAETESPGETTGGS
AESEPPGEGEVQLLESGGGLVQPGGSLKLSCAASGFTFNTYAMNWVRQAPGKGLEWVARIRSKYNNYATYY
ADSVKDRFTISRDDSKNTAYLQMNNLKTEDTAVYYCVRHGNFGNSYVSWFAYWGQGTLVTVSSGTAEAASA
SGLFGRNDNHEPLELGGGPGSPAGSPTSTEEGTSESATPESGPGTSTEPSEGSAPGSPAGSPTSTEEGTST
EPSEGSAPGTSTEPSEGSAPGTSESATPESGPGSEPATSGSETPGSEPATSGSETPGSPAGSPTSTEEGTS
ESATPESGPGTSTEPSEGSAPGTSTEPSEGSAPGSPAGSPTSTEEGSPAGSPTSTEEGTSTEPSEGSAPGT
SESATPESGPGTSTEPSEGSAPGTSESATPESGPGSEPATSGSETPGTSTEPSEGSAPGTSTEPSEGSAPG
TSESATPESGPGTSESATPESGPGSPAGSPTSTEEGTSESATPESGPGSEPATSGSETPGTSESATPESGP
GTSTEPSEGSAPGTSTEPSEGSAPGTSTEPSEGSAPGTSTEPSEGSAPGTSTEPSEGSAPGTSTEPSEGSA
PGSPAGSPTSTEEGTSTEPSEGSAPGTSESATPESGPGSEPATSGSETPGTSESATPESGPGSEPATSGSE
TPGTSESATPESGPGTSTEPSEGSAPGTSESATPESGPGSPAGSPTSTEEGSPAGSPTSTEEGSPAGSPTS
TEEGTSESATPESGPGTSTEPSEGSAPGTSESATPESGPGSEPATSGSETPGTSESATPESGPGSEPATSG
SETPGTSESATPESGPGTSTEPSEGSAPGSPAGSPTSTEEGTSESATPESGPGSEPATSGSETPGTSESAT
PESGPGSPAGSPTSTEEGSPAGSPTSTEEGTSTEPSEGSAPGTSESATPESGPGTSESATPESGPGftabT
SESATPESGPGSEPATSGPTESGSEPATSGSETPGSPAGSPTSTEEGTSTEPSEGSAPGTESTPSEGSAPG
SEPATSGSETPGTSESATPESGPGTSTEPSEGSAPGEPEA |
| 28 | ASSPAGSPTSTESGTSESATPESGPGTETEPSEGSAPGTSESATPESGPGSEPATSGSETPGTSESATPES
GPGSTPAESGSETPGTSESATPESGPGTSTEPSEGSAPGSPAGSPTSTEEGTSESATPESGPGESPATSGS
TPEGTSESATPESGPGSPAGSPTSTEEGSPAGSPTSTEEGTSTEPSEGSAPGTSESATPESGPGTSESATP
ESGPGTSESATPESGPGSEPATSGSETPGSEPATSGSETPGSPAGSPTSTEEGTSTEPSEGSAPGTSTEPS
EGSAPGGSAPTTGRAGEAANATSAGATGPATSGSETPGTDIQMTQSPSSLSASVGDRVTITCRASQDVNTA
VAWYQQKPGKAPKLLIYSASFLYSGVPSRFSGSRSGTDFTLTISSLQPEDFATYYCQQHYTTPPTFGQGTK
VEIKGATPPETGAETESPGETTGGSAESEPPGEGEVQLVESGGGLVQPGGSLRLSCAASGFNIKDTYIHWV
RQAPGKGLEWVARIYPTNGYTRYADSVKGRFTISADTSKNTAYLQMNSLRAEDTAVYYCSRWGGDGFYAMD
YWGQGTLVTVSSGGGSELVVTQEPSLTVSPGGTVTLTCRSSNGAVTTSNYANWVQQKPGQAPRGLIGGTNK
RAPGTPARFSGSLLGGKAALTLSGVQPEDEAVYYCALWYPNLWVFGGGTKLTVLGATPPETGAETESPGET
TGGSAESEPPGEGEVQLLESGGGIVQPGGSLKLSCAASGFTFNTYAMNWVRQAPGKGLEWVARIRSKYNNY
ATYYADSVKDRFTISRDDSKNTVYLQMNNLKTEDTAVYYCVRHENFGNSYVSWFAHWGQGTLVTVSSGTAE
AASASGTTGRAGEAANATSAGATGPSAGSPGSPAGSPTSTEEGTSESATPESGPGTSTEPSEGSAPGSPAG
SPTSTEEGTSTEPSEGSAPGTSTEPSEGSAPGTSESATPESGPGSEPATSGSETPGSPA
GSPTSTEEGTSESATPESGPGTSTEPSEGSAPGTSTEPSEGSAPGSPAGSPTSTEEGTSTEPSEGSAPGTS
TEPSEGSAPGTSESATPESGPGTSTEPSEGSAPGTSESATPESGPGSEPATSGSETPGTSTEPSEGSAPGT
STEPSEGSAPGTSESATPESGPGTSESATPESGPGSPAGSPTSTEEGTSESATPESGPGSEPATSGSETPG
TSESATPESGPGTSTEPSEGSAPGTSTEPSEGSAPGTSTEPSEGSAPGTSTEPSEGSAPGTSTEPSEGSAP
GTSTEPSEGSAPGSPAGSPTSTEEGTSESATPESGPGTSESATPESGPGSEPATSGSETPGTSESATPESG
PGSEPATSGSETPGTSESATPESGPGTSTEPSEGSAPGTSESATPESGPGSPAGSPTSTEEGSPAGSPTST
EEGSPAGSPTSTEEGTSESATPESGPGTSTEPSEGSAPGTSESATPESGPGSEPATSGSETPGTSESATPE
SGPGSEPATSGSETPGTSESATPESGPGTSTEPSEGSAPGSPAGSPTSTEEGTSESATPESGPGSEPATSG
SETPGTSESATPESGPGSPAGSPTSTEEGSPAGSPTSTEEGTSTEPSEGSAPGTSESATPESGPGTSESAT
PESGPGTSESATPESGPGSEPATSGPTGSEPATSGSETPGSPAGSPTSTEEGTSTEPSEGSAPGTSTEPSE
GSEGSSAPGSEPATSGSETPGTSESATPESGPGTSTEPSEGSAPGSPAGSPTSTEEGTSESATPESGPGTSTE
PSEGSAPGSPAGSPTSTEEGTSTEPSEGSAPGTSTEPSEGSAPGTSESATPESGPGSEPATSGSETPGSEP
ATSGSETPGSPAGSPTSTEEGTSESATPESGPGTSTEPSEGSAPGTSTEPSEGSAPGSPAGSPTSTEEGT
STEPSEGSAPGTATESPEGSAPGTSESATPESGPGTSTEPSEGSAPGTSAESATPESGPGSEPATSGSETP
GTSTEPSEGSAPGTSTEPSEGSAPGTSESATPESGPGTESAS |

TABLE D-continued

Exemplary amino acid sequences of polypeptides

| SEQ ID NO. | Amino Acid Sequences |
|---|---|
| 29 | SPAGSPTSTESGTSESATPESGPGTSTEPSEGSAPGTSESATPESGPGSEPATSGSETPGTSESATPESGP GSTPAESGSETPGTSESATPESGPGTSTEPSEGSAPGSPAGSPTSTEEGTSESATPESGPGSEPATSGSET PGTSESATPESGPGSPAGSPTSTEEGSPAGSPTSTEEGTSTEPSEGSAPGTSESATPESGPGTSESATPES GPGTSESATPESGPGSEPATSGSETPGSEPATSGSETPGSPAGSPTSTEEGTSTEPSEGSAPGTSTEPSEG SAPGGSAPTTGRATEAANATPAGLTGPATSGSETPGTDIQMTQSPSSLSASVGDRVTITCKASQDVSIGVA WYQQKPGKAPKLLIYSASYRYTGVPSRFSGSGSGTDFTLTISSLQPEDFATYYCQQYYTYPYTFGQGTKVE IKGATPPETGAETESPGETTGGSAESEPPGEGEVQLVESGGGLVQPGGSLRLSCAASGFTFTDYTMDWVRQ APGKGLEWVADVNPNSGGSIYNQRFKGRFTLSVDRSKNTLYLQMNSLRAEDTAVYYCARNLGPSFYFDYWG QGTLVTVSSGGGSELVVTQEPSLTVSPGGTVTLTCRSSTGAVTTSNYANWVQQKPGQAPRGLIGGTNKRAP GTPARFSGSSLGGSAALTLSGVQPEDEAEYYCALWYSNLWVFGGGTKLTVLGATPPETGAETESPGETTGG SAESEPPGEGEVQLQESGGGLVQPGGSLKLSCAASGFTFNTYAMNWVRQAPGKGLEWVARIRSKYNNYATY YADSVKDRFTISRDDSKNTAYLQMNNLKTEDTAVYYCVRHGNFGNSYVSWFAYWGQGTLVTVSSGTAEAAS ASGTTGRATEAANATPAGLTGPTPESGPGTSESATPESGPGSPAGSPTSTEEGTSESATPESGPGSEPATS GSETPGTSESATPESGPGTSTEPSEGSAPGTSTEPSEGSAPGTSTEPSEGSAPGTSTEP SEGSAPGTSTEPSEGSAPGSPAGSPTSTEEGTSTEPSEGSAPGTSESATPESGPGSEPATSGSETPGTSES ATPESGPGSEPATSGSETPGTSESATPESGPGTSTEPSEGSAPGTSESATPESGPGSPAGSPTSTEEGSPA GSPTSTEEGSPAGSPTSTEEGTSESATPESGPGTSTEPSEGSAPGTSESATPESGPGSEPATSGSETPGTS ESATPESGPGSEPATSGSETPGTSESATPESGPGTSTEPSEGSAPGSPAGSPTSTEEGTSESATPESGPGS EPATSGSETPGTSESATPESGPGSPAGSPTSTEEGSPAGSPTSTEEGTSTEPSEGSAPGTSESATPESGPG TSESATPESGPGTSESATPESGPGSEPATSGSETPGSESATSGSETPGSPAGSPTSTEEGTSTEPSEGSAP GTSTEPSEGSAPGSEPATSGSETPGTSESA |
| 30 | GSPAGSPTSTEEGTSESATPESGPGTSTEPSEGSAPGSPAGSPTSTEEGTSTEPSEGSAPGTSTEPSEGSA PGTSESATPESGPGSESATSGSETPGSEPATSGSETPGSPAGSPTSTEEGTSESATPESGPGTSTEPSEGS APGTSTEPSEGSAPGSPAGSPTSTEEGTSTEPSEGSAPGTSTEPSEGSAPGTSESATPESGPGTSTEPSEG SAPGTSESATPESGPGSEPATSGSETPGTSTEPSEGSAPGTSTEPSEGSAPGTSESATPESGPGTSESATP ESGPGSPAGSPTSTEEGTSESATPESGPGSEPATSGSETPGTSESATPESGPGTSTEPSEGSAPGTSTEPS EGSAPGTSTEPSEGSAPGTSTEPSEGSAPGTSTEPSEGSAPGSPAGSPTSTEEGTSTEEP SEGSAPGTSESATPESGPGSEPATSGSETPGTSESATPESGPGSEPATSGSETPGTSESATPESGPGTSTE PSEGSAPGTSESATPESGPGSPAGSPTSTEEGSPAGSPTSTEEGSPAGSPTSTEEGTSESATPESGPGTST EPSEGSAPGTSESATPESGPGSEPATSGSETPGTSESATPESGPGSEPATSGSETPGTSESATPESGPGTS TEPSEGSAPGSPAGSPTSTEEGTSESATPESGPGSEPATSGSETPGTSESATPESGPGSPAGSPTSTEEGS PAGSPTSTEEGTSTEPSEGSAPGTSESATPESGPGTSESATPESGPGSEPATSGSETPG SEPATSGSETPGSPAGSPTSTEEGTSTEPSEGSAPGTSTEPSEGSAPGSEPATSGSETPGTSESATPESGP GTSTEPSEGSAPTTARAGSAENLSPSGLTGPATSGSETPGTDIQMTQSPSSLSASVGDRVTITCKASQDVS IGVAWYQQKPGKAPKLLIYSASYRYTGVPSRFSGSGSGTDFTLTISSLQPEDFATYYCQQYYTYPYTFGQG TKVEIKGATPPETGAETESPGETTGGSAESEPPGEGEVQLVESGGGLVQPGGSLRLSCAASGFTFTDYTMD WVRQAPGKGLEWVADVNPNSGGSIYNQRFKGRFTLSVDRSKNTLYLQMNSLRAEDTAVYYCARNLGPSFYF DYWGQGTLVTVSSGGGSELVVTQEPSLTVSPGGTVTLTCRSSNGAVTSSNYANWVQQKPGQAPRGLIGGTN KRAPGTPARFSGSSLGGKAALTLSGVQPEDEAVYYCALWYPNLWVFGGGTKLTVLGATPPETGAETESPGE TTGGSAESEPPGEGEVQLQESGGGIVQPGGSLKLSCAASGFTFNTYAMNWVRQAPGKGLEWVARIRSKYNN YATYYADSVKDRFTISRDDSKNTVYLQMNNLKTEDTAVYYCVRHENFGNSYVSWFAHWGQGTLVTVSSGTA EAASASGTTARAGSAENLSPSGLTGPEGSAPGTSTEPSEGSAPGTSESATPESGPGTSTEPSEGSAPGTSE SATPESGPGSEPATSGSETPGTSTEPSEGSAPGTSTEPSEGSAPGTSESATPESGPGTSESATPESGPGSP AGSPTSTEEGTSESATPESGPGSEPATSGSETPGTSESATPESGPGSEPATSGSETPGSEPATSGSETPGSEPATSGSETPGSEPATSGSETPGAPGT STEPSEGSAPGTSTEPSEGSAPGTSTEPSEGSAPGTSTEPSEGSAPGSPAGSPTSTEEGTSTEPSEGSAPG TSESATPESGPGSEPATSGSETPGTSESATPESGPGSEPATSGSETPGTSESATPESGPGTSTEPSEGSAP GTSESATPESGPGSPAGSPTSTEEGSPAGSPTSTEEGSPAGSPTSTEEGTSESATPESGPGTSTEPSEGSA PGTSESATPESGPGSEPATSGSETPGTSESATPESGPGSEPATSGSETPGTSESASPESGPGTSTEPSEGS APGSPAGSPTSTEEGTSESATPESGPGSEPATSGSETPGTSESATPESGPGSPAGSPTSTEEGSPAGSPTS TEEGTSTEPSEGSAPGTSESATPESGPGTSESAT |
| 31 | GSPAGSPTSTEEGTSESATPESGPGTSTEPSEGSAPGSPAGSPTSTEEGTSTEPSEGSAPGTSTEPSEGSA PGTSESATPESGPGSESATSGSETPGSEPATSGSETPGSPAGSPTSTEEGTSESATPESGPGTSTEPSEGS APGTSTEPSEGSAPGSPAGSPTSTEEGTSTEPSEGSAPGTSTEPSEGSAPGTSESATPESGPGTSTEPSEG SAPGTSESATPESGPGSEPATSGSETPGTSTEPSEGSAPGTSTEPSEGSAPGTSESATPESGPGTSESATP ESGPGSPAGSPTSTEEGTSESATPESGPGSEPATSGSETPGTSESATPESGPGTSTEPSEGSAPGTSTEPS EGSAPGTSTEPSEGSAPGTSTEPSEGSAPGTSTEEGSAPGSPAGSPTSTEEGTSTEEP SEGSAPGTSESATPESGPGSEPATSGSETPGTSESATPESGPGSEPATSGSETPGTSESATPESGPGTSTE PSEGSAPGTSESATPESGPGSPAGSPTSTEEGSPAGSPTSTEEGSPAGSPTSTEEGTSESATPESGPGTST EPSEGSAPGTSESATPESGPGSEPATSGSETPGTSESATPESGPGSEPATSGSETPGTSESATPESGPGTS TEPSEGSAPGSPAGSPTSTEEGTSESATPESGPGSEPATSGSETPGTSESATPESGPGSPAGSPTSTEEGS PAGSPTSTEEGTSTEPSEGSAPGTSESATPESGPGTSESATPESGPGTSESATPESGPGSEPATSGSETPG SEPATSGSETPGSPAGSPTSTEEGTSTEPSEGSAPGTSTEPSEGSAPGSEPATSGSETPGTSESATPESGP GTSTEPSEGSAPTTGRAGEAEGATSAGATGPATSGSETPGTDIQMTQSPSSLSASVGDRVTITCKASQDVS IGVAWYQQKPGKAPKLLIYSASYRYTGVPSRFSGSGSGTDFTLTISSLQPEDFATYYCQQYYTYPYTFGQG TKVEIKGATPPETGAETESPGETTGGSAESEPPGEGEVQLVESGGGLVQPGGSLRLSCAASGFTFTDYTMD WVRQAPGKGLEWVADVNPNSGGSIYNQRFKGRFTLSVDRSKNTLYLQMNSLRAEDTAVYYCARNLGPSFYF DYWGQGTLVTVSSGGGSELVVTQEPSLTVSPGGTVTLTCRSSTGAVTTSNYANWVQQKPGQAPRGLIGGTN KRAPGTPARFSGSLLGGKAALTLSGVQPEDEAEYYCALWYSNLWVFGGGTKLTVLGATPPETGAETESPGE TTGGSAESEPPGEGEVQLLESGGGLVQPGGSLKLSCAASGFTFNTYAMNWVRQAPGKGLEWVARIRSKYNN YATYYADSVKDRFTISRDDSKNTAYLQMNNLKTEDTAVYYCVRHGNFGNSYVSWFAYWGQGTLVTVSSGTA EAASASGTTGRAGEAEGATSAGATGPPGSPAGSPTSTEEGTSESATPESGPGTSTEPSEGSAPGSPAGSPT STEEGTSTEPSEGSAPGTSTEPSEGSAPGTSESATPESGPGSEPATSGSETPGSEPATSGSETPGSPAGSP TSTEEGTSESATPESGPGTSTEPSEGSAPGTSTEPSEGSAPGSPAGSPTSTEEGTSTEPSEGSAPGTSTEP |

TABLE D-continued

Exemplary amino acid sequences of polypeptides

| SEQ ID NO. | Amino Acid Sequences |
|---|---|
| | SEGSAPGTSESATPESGPGTSTEPSEGSAPGTSESATPESGPGSEPATSGSETPGTSTEPSEGSAPGTSTE<br>PSEGSAPGTSESATPESGPGTSESATPESGPGSPAGSPTSTEEGTSESATPESGPGSEPATSGSETPGTSE<br>SATPESGPGTSTEPSEGSAPGTSTEPSEGSAPGTSTEPSEGSAPGTSTEPSEGSAPGTSTEPSEGSAPGTS<br>TEPSEGSAPGSPAGSPTSTEEGTSTEPSEGSAPGTSESATPESGPGSEPATSGSETPGTSESATPESGPGS<br>EPATSGSETPGTSESATPESGPGTSTEPSEGSAPGTSESATPESGPGSPAGSPTSTEEGSPAGSPTSTEEG<br>SPAGSPTSTEEGTSESATPESGPGTSTEPSEGSAPGTSESATPESGPGSEPATSGSETPGTSESATPESGP<br>GSEPATSGSETPGTSESATPESGPGTSTEPSEGSAPGSPAGSPTSTEEGTSESATPESGPGSEPATSGSET<br>PGTSESATPESGPGSPAGSPTSTEEGSPAGSPTSTEEGTSTEPSEGSAPGTSESATPESGPGTSESATPES<br>GPGTSESATPESGPGSEPATSGSETPGSEPATSGSETPGSPAGSPTSTEEGTSTEPSEGSAPGTSESTPSEG<br>SAPGSEPATSGSETPGTSESATPESGPGTSTEPSEGSAPG |
| 32 | ASSPAGSPTSTESGTSESATPESGPGTSTEPSEGSAPGTSESATPESGPGSEPATSGSETPGTSESATPES<br>GPGSTPAESGSETPGTSESATPESGPGTSTEPSEGSAPGSPAGSPTSTEEGTSESATPESGPGESPATSGS<br>TPEGTSESATPESGPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEPSEGSAPGTSTEPS<br>EGSAPGSSAPPTGRSGEGANATPSGLTGPATSGSETPGTDIQMTQSPSSLSASVGDRVTITCRASQDVNTA<br>VAWYQQKPGKAPKLLIYSASFLYSGVPSRFSGSRSGTDFTLTISSLQPEDFATYYCQQHYTTPPTFGQGTK<br>VEIKGATPPETGAETESPGETTGGSAESEPPGEGEVQLVESGGGLVQPGGSLRLSCAASGFNIKDTYIHWV<br>RQAPGKGLEWVARIYPTNGYTRYADSVKGRFTISADTSKNTAYLQMNSLRAEDTAVYYCSRWGGDGFYAMD<br>YWGQGTLVTVSSGGGSELVVTQEPSLTVSPGGTVTLTCRSSTGAVTTSNYANWVQQKPGQAPRGLIGGTNK<br>RAPGTPARFSGSLLGGKAALTLSGVQPEDEAEYYCALWYSNLWVFGGGTKLTVLGATPPETGAETESPGET<br>TGGSAESEPPGEGEVQLLESGGGLVQPGGSLKLSCAASGFTFNTYAMNWVRQAPGKGLEWVARIRSKYNNY<br>ATYYADSVKDRFTISRDDSKNTAYLQMNNLKTEDTAVYYCVRHGNFGNSYVSWFAYWGQGTLVTVSSGTAE<br>AASASGPTGRSGEGANATPSGLTGPPGSPAGSPTSTEEGTSESATPESGPGTSTEPSEGSAPGSPAGSPTS<br>TEEGTSTEPSEGSAPGTSTEPSEGSAPGTSESATPESGPGSEPATSGSETPGSEPATSGSETPGSPAGSPT<br>STEEGTSESATPESGPGTSTEPSEGSAPGTSTEPSEGSAPGSPAGSPTSTEEGTSTEPSEGSAPGTSTEPS<br>EGSAPGTSESATPESGPGTSTEPSEGSAPGTSESATPESGPGSEPATSGSETPGTSTEPSEGSAPGTSTEP<br>SEGSAPGTSESATPESGPGTSESATPESGPGSPAGSPTSTEEGTSESATPESGPGSEPATSGSETPGTSES<br>ATPESGPGTSTEPSEGSAPGTSTEPSEGSAPGTSTEPSEGSAPGTSTEPSEGSAPGTSTEPSEGSAPGTST<br>EPSEGSAPGSPAGSPTSTEEGTSTEPSEGSAPGTSESATPESGPGSEPATSGSETPGTSESATPESGPGSE<br>PATSGSETPGTSESATPESGPGTSTEPSEGSAPGTSESATPESGPGSPAGSPTSTEEGSPAGSPTSTEEGS<br>PAGSPTSTEEGTSESATPESGPGTSTEPSEGSAPGTSESATPESGPGSEPATSGSETPGTSESATPESGPG<br>SEPATSGSETPGTSESATPESGPGTSTEPSEGSAPGSPAGSPTSTEEGTSESATPESGPGSEPATSGSETP<br>GTSESATPESGPGSPAGSPTSTEEGSPAGSPTSTEEGTSTEPSEGSAPGTSESATPESGPGTSESATPESG<br>PGftabTSESATPESGPGSEPATSGPTESGSEPATSGSETPGSPAGSPTSTEEGTSTEPSEGSAPGTESTP<br>SEGSAPGSEPATSGSETPGTSESATPESGPGTSTEPSEGSAPGEPEA |
| 33 | ASSPAGSPTSTESGTSESATPESGPGTSTEPSEGSAPGTSESATPESGPGSEPATSGSETPGTSESATPES<br>GPGSTPAESGSETPGTSESATPESGPGTSTEPSEGSAPGSPAGSPTSTEEGTSESATPESGPGSEPATSGS<br>ETPGTSESATPESGPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEPSEGSAPGTSTEPS<br>EGSAPGGSAPLGGRADNHEPPELGAGATSGSETPGTDIQMTQSPSSLSASVGDRVTITCRASQDVNTAVAW<br>YQQKPGKAPKLLIYSASFLYSGVPSRFSGSRSGTDFTLTISSLQPEDFATYYCQQHYTTPPTFGQGTKVEI<br>KGATPPETGAETESPGETTGGSAESEPPGEGEVQLVESGGGLVQPGGSLRLSCAASGFNIKDTYIHWVRQA<br>PGKGLEWVARIYPTNGYTRYADSVKGRFTISADTSKNTAYLQMNSLRAEDTAVYYCSRWGGDGFYAMDYWG<br>QGTLVTVSSGGGSELVVTQEPSLTVSPGGTVTLTCRSSNGAVTSSNYANWVQQKPGQAPRGLIGGTNKRAP<br>GTPARFSGSLLGGKAALTLSGVQPEDEAVYYCALWYPNLWVFGGGTKLTVLGATPPETGAETESPGETTGG<br>SAESEPPGEGEVQLLESGGGIVQPGGSLKLSCAASGFTFNTYAMNWVRQAPGKGLEWVARIRSKYNNYATY<br>YADSVKDRFTISRDDSKNTVYLQMNNLKTEDTAVYYCVRHENFGNSYVSWFAHWGQGTLVTVSSGTAEAAS<br>ASGLGGRADNHEPPELGAGTPESGPGTSESATPESGPGSPAGSPTSTEEGTSESATPESGPGSEPATSGSE<br>TPGTSESATPESGPGTSTEPSEGSAPGTSTEPSEGSAPGTSTEPSEGSAPGTSTEPSEGSAPGTSTEPSEG<br>SAPGTSTEPSEGSAPGSPAGSPTSTEEGTSTEPSEGSAPGTSESATPESGPGSEPATSGSETPGTSESATP<br>ESGPGSEPATSGSETPGTSESATPESGPGTSTEPSEGSAPGTSESATPESGPGSPAGSPTSTEEGSPAGSP<br>TSTEEGSPAGSPTSTEEGTSESATPESGPGTSTEPSEGSAPGTSESATPESGPGSEPATSGSETPGTSESA<br>TPESGPGSEPATSGSETPGTSESATPESGPGTSTEPSEGSAPGSPAGSPTSTEEGTSESATPESGPGSEPA<br>TSGSETPGTSESATPESGPGSPAGSPTSTEEGSPAGSPTSTEEGTSTEPSEGSAPGTSESATPESGPGTSE<br>SATPESGPGTSESATPESGPGSEPATSGSETPGSESATSGSETPGSPAGSPTSTEEGTSTEPSEGSAPGTS<br>TEPSEGSAPGSEPATSGSETPGTSESA |
| 34 | ASSPAGSPTSTESGTSESATPESGPGTSTEPSEGSAPGTSESATPESGPGSEPATSGSETPGTSESATPES<br>GPGSTPAESGSETPGTSESATPESGPGTSTEPSEGSAPGSPAGSPTSTEEGTSESATPESGPGSEPATSGS<br>ETPGTSESATPESGPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEPSEGSAPGTSTEPS<br>EGSAPGGSAPEAGRSANHTPAGLTGPATSGSETPGTDIQMTQSPSSLSASVGDRVTITCKASQDVSIGVAW<br>YQQKPGKAPKLLIYSASYRYTGVPSRFSGSGSGTDFTLTISSLQPEDFATYYCQQYYTYPYTFGQGTKVEI<br>KGATPPETGAETESPGETTGGSAESEPPGEGEVQLVESGGGLVQPGGSLRLSCAASGFTFTDYTMDWVRQA<br>PGKGLEWVADVNPNSGGSIYNQRFKGRFTLSVDRSKNTLYLQMNSLRAEDTAVYYCARNLGPSFYFDYWGQ<br>GTLVTVSSGGGSELVVTQEPSLTVSPGGTVTLTCRSSNGAVTSSNYANWVQQKPGQAPRGLIGGTNKRAP<br>GTPARFSGSLLGGKAALTLSGVQPEDEAVYYCALWYPNLWVFGGGTKLTVLGATPPETGAETESPGETTGG<br>SAESEPPGEGEVQLLESGGGIVQPGGSLKLSCAASGFTFNTYAMNWVRQAPGKGLEWVARIRSKYNNYATY<br>YADSVKDRFTISRDDSKNTVYLQMNNLKTEDTAVYYCVRHENFGNSYVSWFAHWGQGTLVTVSSGTAEAAS<br>ASGEAGRSANHTPAGLTGPPGSPAGSPTSTEEGTSESATPESGPGSEPATSGSETPGTSESATPESGPGTS<br>TEPSEGSAPGTSTEPSEGSAPGTSTEPSEGSAPGTSTEPSEGSAPGTSTEPSEGSAPGTSTEPSEGSAPGS<br>PAGSPTSTEEGTSTEPSEGSAPGTSESATPESGPGSEPATSGSETPGTSESATPESGPGSEPATSGSETPG<br>TSESATPESGPGTSTEPSEGSAPGTSESATPESGPGSPAGSPTSTEEGSPAGSPTSTEEGSPAGSPTSTEE |

TABLE D-continued

Exemplary amino acid sequences of polypeptides

| SEQ ID NO. | Amino Acid Sequences |
|---|---|
| | GTSESATPESGPGTSTEPSEGSAPGTSESATPESGPGSEPATSGSETPGTSESATPESGPGSEPATSGSET<br>PGTSESATPESGPGTSTEPSEGSAPGSPAGSPTSTEEGTSESATPESGPGSEPATSGSETPGTSESATPES<br>GPGSPAGSPTSTEEGSPAGSPTSTEEGTSTEPSEGSAPGTSESATPESGPGTSESATPESGPGTSESATPE<br>SGPGSEPATSGSETPGSEPATSGSETPGSPAGSPTSTEEGTSTEPSEGSAPGTSESTPSEGSAPGSEPATSG<br>SETPGTSESATPESGPGTSTEPSEGSAPGEPEA |
| 35 | ASSPAGSPTSTESGTSESATPESGPGTSTEPSEGSAPGTSESATPESGPGSEPATSGSETPGTSESATPES<br>GPGSTPAESGSETPGTSESATPESGPGTSTEPSEGSAPGSPAGSPTSTEEGTSESATPESGPGSEPATSGS<br>ETPGTSESATPESGPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEPSEGSAPGTSTEPS<br>EGSAPGGSAPGAGRTDNHEPLELGAAATSGSETPGTEIVLTQSPATLSLSPGERATLSCKASQDVSIGVAW<br>YQQKPGQAPRLLIYSASYRYSGVPARFSGSGSGTDFTLTISSLEPEDFAVYYCQQYYTYPYTFGQGTKVEI<br>KGATPPETGAETESPGETTGGSAESEPPGEGQVQLVQSGVEVKKPGASVKVSCKASGFTFTDYTMDWVRQA<br>PGQGLEWMADVNPNSGGSIYNQRFKGRVTLTTDSSTTTAYMELKSLQFDDTAVYYCARNLGPSFYFDYWGQ<br>GTLVTVSSGGGSELVVTQEPSLTVSPGGTVTLTCRSSTGAVTTSNYANWVQQKPGQAPRGLIGGTNKRAPG<br>TPARFSGSSLGGSAALTLSGVQPEDEAEYYCALWYSNLWVFGGGTKLTVLGATPPETGAETESPGETTGGS<br>AESEPPGEGEVQLQESGGGLVQPGGSLKLSCAASGFTFNTYAMNWVRQAPGKGLEWVARIRSKYNNYATYY<br>ADSVKDRFTISRDDSKNTAYLQMNNLKTEDTAVYYCVRHGNFGNSYVSWFAYWGQGTLVTVSSGTAEAASA<br>SGGAGRTDNHEPLELGAAPGSPAGSPTSTEEGTSESATPESGPGSEPATSGSETPGTSESATPESGPGTST<br>EPSEGSAPGTSTEPSEGSAPGTSTEPSEGSAPGTSESATPESGPGTSTEPSEGSAPGTSTEPSEGSAPGSP<br>AGSPTSTEEGTSTEPSEGSAPGTSESATPESGPGSEPATSGSETPGTSESATPESGPGSEPATSGSETPGT<br>SESATPESGPGTSTEPSEGSAPGTSESATPESGPGSPAGSPTSTEEGSPAGSPTSTEEGSPAGSPTSTEEG<br>TSESATPESGPGTSTEPSEGSAPGTSESATPESGPGSEPATSGSETPGTSESATPESGPGSEPATSGSETP<br>GTSESATPESGPGTSTEPSEGSAPGSPAGSPTSTEEGTSESATPESGPGSEPATSGSETPGTSESATPESG<br>PGSPAGSPTSTEEGSPAGSPTSTEEGTSTEPSEGSAPGTSESATPESGPGTSESATPESGPGTSESATPES<br>GPGSEPATSGSETPGSEPATSGSETPGSPAGSPTSTEEGTSTEPSEGSAPGTESTPSEGSAPGSEPATSGS<br>ETPGTSESATPESGPGTSTEPSEGSAPGEPEA |
| 36 | GSPAGSPTSTEEGTSESATPESGPGTSTEPSEGSAPGSPAGSPTSTEEGTSTEPSEGSAPGTSTEPSEGSA<br>PATSESATPESGPGSEPATSGSETPGSEPATSGSETPGSPAGSPTSTEEGTSESASPESGPGTSTEPSEGS<br>APGTSTEPSEGSAPGSPAGSPTSTEEGTSTEPSEGSAPGTSTEPSEGSAPGTSESATPESGPGTSTEPSEG<br>SAPGTSESATPESGPGSEPATSGSETPGTSTEPSEGSAPGTSTEPSEGSAPGTSESATPESGPGTSESATP<br>ESGPGSPAGSPTSTEEGTSESATPESGPGSEPATSGSETPGTSESATPESGPGTSTEPSEGSAPGTSTEPS<br>EGSAPGTSTEPSEGSAPGTSTEPSEGSAPGTSTEPSEGSAPGTSTEPSEGSAPGSPAGSPTSTEEGTSTEP<br>SEGSAPGTSESATPESGPGSEPATSGSETPGTSESATPESGPGSEPATSGSETPGTSESATPESGPGTSTE<br>PSEGSAPGTSESATPESGPGSPAGSPTSTEEGSPAGSPTSTEEGSPAGSPTSTEEGTSESATPESGPGTST<br>EPSEGSAPGTSESATPESGPGSEPATSGSETPGTSESATPESGPGSEPATSGSETPGTSESATPESGPGTS<br>TEPSEGSAPGSPAGSPTSTEEGTSESATPESGPGSEPATSGSETPGTSESATPESGPGSPAGSPTSTEEGS<br>PAGSPTSTEEGTSTEPSEGSAPGTSESATPESGPGTSESATPESGPGTSESATPESGPGSEPATSGSETPG<br>SEPATSGSETPGSPAGSPTSTEEGTSTEPSEGSAPGTSTEPSEGSAPGSEPATSGSETPGTSESATPESGP<br>GTSTEPSEGSAPASGRAANETPPGLTGAATSGSETPGTEIVLTQSPATLSLSPGERATLSCKASQDVSIGV<br>AWYQQKPGQAPRLLIYSASYRYSGVPARFSGSGSGTDFTLTISSLEPEDFAVYYCQQYYIYPYTFGQGTKV<br>EIKGATPPETGAETESPGETTGGSAESEPPGEGQVQLVQSGVEVKKPGASVKVSCKASGFTFTDYTMDWVR<br>QAPGQGLEWMADVNPNSGGSIYNQRFKGRVTLTTDSSTTTAYMELKSLQFDDTAVYYCARNLGPSFYFDYW<br>GQGTLVTVSSGGGSELVVTQEPSLTVSPGGTVTLTCRSSNGAVTTSNYANWVQQKPGQAPRGLIGGTNKRA<br>PGTPARFSGSSLGGKAALTLSGVQPEDEAVYYCALWYPNLWVFGGGTKLTVLGATPPETGAETESPGETTG<br>GSAESEPPGEGEVQLQESGGGIVQPGGSLKLSCAASGFTFNTYAMNWVRQAPGKGLEWVARIRSKYNNYAT<br>YYADSVKDRFTISRDDSKNTVYLQMNNLKTEDTAVYYCVRHENFGNSYVSWFAHWGQGTLVTVSSGTAEAA<br>SASGASGRAANETPPGLTGASAGSPGSPAGSPTSTEEGTSESATPESGPGTSTEPSEGSAPGSPAGSPTST<br>EEGTSTEPSEGSAPGTSTEPSEGSAPGTSESATPESGPGSEPATSGSETPGSEPATSGSETPGSPAGSPTS<br>TEEGTSESATPESGPGTSTEPSEGSAPGTSTEPSEGSAPGSPAGSPTSTEEGTSTEPSEGSAPGTSTEPSE<br>GSAPGTSESATPESGPGTSTEPSEGSAPGTSESATPESGPGSEPATSGSETPGTSTEPSEGSAPGTSTEPS<br>EGSAPGTSESATPESGPGTSESATPESGPGSPAGSPTSTEEGTSESATPESGPGSEPATSGSETPGTSESA<br>TPESGPGTSTEPSEGSAPGTSTEPSEGSAPGTSTEPSEGSAPGTSTEPSEGSAPGTSTEPSEGSAPGTSTE<br>PSEGSAPGSPAGSPTSTEEGTSTEPSEGSAPGTSESATPESGPGSEPATSGSETPGTSESATPESGPGSEP<br>ATSGSETPGTSESATPESGPGTSTEPSEGSAPGTSESATPESGPGSPAGSPTSTEEGSPAGSPTSTEEGSP<br>AGSPTSTEEGTSESATPESGPGTSTEPSEGSAPGTSESATPESGPGSEPATSGSETPGTSESATPESGPGS<br>EPATSGSETPGTSESATPESGPGTSTEPSEGSAPGSPAGSPTSTEEGTSESATPESGPGSEPATSGSETPG<br>TSESATPESGPGSPAGSPTSTEEGSPAGSPTSTEEGTSTEPSEGSAPGTSESATPESGPGTSESATPESGP<br>GTSESATPESGPGSEPATSGSETPGSEPATSGSETPGSPAGSPTSTEEGTSTEPSEGSAPGTSTEPSEGSA<br>PGSEPATSGSETPGTSESATPESGPGTSTEPSEGSAPGSPAGSPTSTEEGTSESATPESGPGTSTEPSEGS<br>APGSPAGSPTSTEEGTSTEPSEGSAPGTSTEPSEGSAPGTSESATPESGPGSEPATSGSETPGSEPATSGS<br>TETPGSPAGSPTSTEEGTSESATPESGPGTSTEPSEGSAPGTSTEPSEGSAPGSPAGSPTSTEEGTSTEPS<br>EGSAPGTATESPEGSAPGTSESATPESGPGTSTEPSEGSAPGTSAESATPESGPGSEPATSGSETPGTSTE<br>PSEGSAPGTSTEPSEGSAPGTSESATPESGPGTSESAS |
| 37 | SAGSPGSPAGSPTSTEEGTSESATPESGPGTSTEPSEGSAPGSPAGSPTSTEEGTSTEPSEGSAPGTSTEP<br>SEGSAPGTSESATPESGPGSTPAESGSETPGSEPATSGSETPGSPAGSPTSTEEGTSESATPESGPGTSTE<br>PSEGSAPGTSTEPSEGSAPGSPAGSPTSTEEGTSTEPSEGSAPGTSTEPSEGSAPGTSESATPESGPGTST<br>EPSEGSAPGTSESATPESGPGSEPATSGSETPGTSTEPSEGSAPGTSTEPSEGSAPGTSESATPESGPGT<br>SESATPESGPGSPAGSPTSTEEGTSESATPESGPGSEPATSGSETPGTSESATPESGPGTSTEPSEGSAPG<br>TSTEPSEGSAPGTSTEPSEGSAPGTSTEPSEGSAPGTSTEPSEGSAPGTSTEPSEGSAPGSPAGSPTSTEE<br>GTSTEPSEGSAPGTSESATPESGPGSEPATSGSETPGTSESATPESGPGSEPATSGSETPGTSESATPESG<br>PGTSTEPSEGSAPGTSESATPESGPGSPAGSPTSTEEGSPAGSPTSTEEGSPAGSPTSTEEGTSESATPES<br>GPGTSTEPSEGSAPGTSESATPESGPGSEPATSGSETPGTSESATPESGPGSEPATSGSETPGTSESATPE |

TABLE D-continued

Exemplary amino acid sequences of polypeptides

| SEQ ID NO. | Amino Acid Sequences |
|---|---|
|  | SGPGTSTEPSEGSAPGSPAGSPTSTEEGTSESATPESGPGSEPATSGSETPGTSESATPESGPGSPAGSPT<br>STEEGSPAGSPTSTEEGTSTEPSEGSAPGTSESATPESGPGTSESATPESGPGTSESATPESGPGSEPATS<br>GSETPGSEPATSGSETPGSPAGSPTSTEEGTSTEPSEGSAPGTSTEPSEGSAPGSPAGSPTSTEEGTSESA<br>TPESGPGTSTEPSEGSAPGSPAGSPTSTEEGTSESATPESGPGTSTEPSEGSAPGSPAGSPTSTEEGTSE<br>PSEGSAPGTSTEPSEGSAPGTSESATPESGPGSEPATSGSETPGSEPATSGSETPGSPAGSPTSTEEGTSE<br>SATPESGPGTSTEPSEGSAPGTSTEPSEGSAPGSPAGSPTSTEEGTSTEPSEGSAPGTSTEPSEGSAPGTS<br>ESATPESGPGTSTEPSEGSAPGTSESATPESGPGSEPATSGSETPGTSTEPSEGSAPGTSTEPSEGSAPGT<br>SESATPESGPGTESASESGRAANTGPPTLTAPATSGSETPGTDIQMTQSPSSLSASVGDRVTITCKASQDV<br>SIGVAWYQQKPGKAPKLLIYSASYRYTGVPSRFSGSGSGTDFTLTISSLQPEDFATYYCQQYYTYPYTFGQ<br>GTKVEIKGATPPETGAETESPGETTGGSAESEPPGEGEVQLVESGGGLVQPGGSLRLSCAASGFTFTDYTM<br>DWVRQAPGKGLEWVADVNPNSGGSIYNQRFKGRFTLSVDRSKNTLYLQMNSLRAEDTAVYYCARNLGPSFY<br>FDYWGQGTLVTVSSGGGSELVVTQEPSLTVSPGGTVTLTCRSSNGAVTSSNYANWVQQKPGQAPRGLIGGT<br>NKRAPGTPARFSGSSLGGKAALTLSGVQPEDEAVYYCALWYPNLWVFGGGTKLTVLGATPPETGAETESPG<br>ETTGGSAESEPPGEGEVQLQESGGGIVQPGGSLKLSCAASGFTFNTYAMNWVRQAPGKGLEWVARIRSKYN<br>NYATYYADSVKDRFTISRDDSKNTVYLQMNNLKTEDTAVYYCVRHENFGNSYVSWFAHWGQGTLVTVSSGT<br>AEAASASGESGRAANTGPPTLTAPSAGSPGSPAGSPTSTEEGTSESATPESGPGTSTEPSEGSAPGSPAGS<br>PTSTEEGTSTEPSEGSAPGTSTEPSEGSAPGTSESATPESGPGSEPATSGSETPGSEPATSGSETPGSPAG<br>SPTSTEEGTSESATPESGPGTSTEPSEGSAPGTSTEPSEGSAPGSPAGSPTSTEEGTSTEPSEGSAPGTST<br>EPSEGSAPGTSESATPESGPGTSTEPSEGSAPGTSESATPESGPGSEPATSGSETPGTSTEPSEGSAPGTS<br>TEPSEGSAPGTSESATPESGPGTSESATPESGPGSPAGSPTSTEEGTSESATPESGPGSEPATSGSETPGT<br>SESATPESGPGTSTEPSEGSAPGTSTEPSEGSAPGTSTEPSEGSAPGTSTEPSEGSAPGTSTEPSEGSAPG<br>TSTEPSEGSAPGSPAGSPTSTEEGTSTEPSEGSAPGTSESATPESGPGSEPATSGSETPGTSESATPESGP<br>GSEPATSGSETPGTSESATPESGPGTSTEPSEGSAPGTSESATPESGPGSPAGSPTSTEEGSPAGSPTSTE<br>EGSPAGSPTSTEEGTSESATPESGPGTSTEPSEGSAPGTSTEPSEGSAPGTSESATPESGPGSEPATSGSE<br>TPGSEPATSGSETPGTSESATPESGPGTSTEPSEGSAPGSPAGSPTSTEEGTSESATPESGPGSEPATSGS<br>ETPGTSESATPESGPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEPSEGSAPGTSTEPS<br>EGSAPGSEPATSGSETPGTSESATPESGPGTSTEPSEGSAPGSPAGSPTSTEEGTSESATPESGPGTSTEP<br>SEGSAPGSPAGSPTSTEEGTSTEPSEGSAPGTSTEPSEGSAPGTSESATPESGPGSEPATSGSETPGSEPA<br>TSGSETPGTSESATPESGPGSPTSTEEGTSESATPESGPGTSTEPSEGSAPGTSTEPSEGSAPGSPAGSPTSTEEGTS<br>TEPSEGSAPGTATESPEGSAPGTSESATPESGPGTSTEPSEGSAPGTSAESATPESGPGSEPATSGSETPG<br>TSTEPSEGSAPGTSTEPSEGSAPGTSESATPESGPGTSESAS |
| 38 | ASSPAGSPTSTESGTSESATPESGPGTETEPSEGSAPGTSESATPESGPGSEPATSGSETPGTSESATPES<br>GPGSTPAESGGSETPGTSESATPESGPGTSTEPSEGSAPGSPAGSPTSTEEGTSESATPESGPGESPATSGS<br>TPEGTSESATPESGPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEPSEGSAPGTSTEPS<br>EGSAPGGSAPASGRGTNAGPAGLTGPATSGSETPGTEIVLTQSPATLSLSPGERATLSCKASQDVSIGVAW<br>YQQKPGKAPRLLIYSASYRYSGVPARFSGSGSGTDFTLTISSLEPEDFAVYYCQQYYIYPYTFGQGTKVEI<br>KGATPPETGAETESPGETTGGSAESEPPGEGQVQLVQSGVEVKKPGASVKVSCKASGFTFTDYTMDWVRQA<br>PGQGLEWMADVNPNSGGSIYNQRFKGRVTLTTDSSTTTAYMELKSLQFDDTAVYYCARNLGPSFYFDYWGQ<br>GTLVTVSSGGGSELVVTQEPSLTVSPGGTVTLTCRSSTGAVTTSNYANWVQQKPGQAPRGLIGGTNKRAPG<br>TPARFSGSLLGGKAALTLSGVQPEDEAEYYCALWYSNLWVFGGGTKLTVLGATPPETGAETESPGETTGGS<br>AESEPPGEGEVQLLESGGGLVQPGGSLKLSCAASGFTFNTYAMNWVRQAPGKGLEWVARIRSKYNNYATYY<br>ADSVKDRFTISRDDSKNTAYLQMNNLKTEDTAVYYCVRHGNFGNSYVSWFAYWGQGTLVTVSSGTAEAASA<br>SGASGRGTNAGPAGLTGPEGSAPGTSTEPSEGSAPGTSESATPESGPGTSTEPSEGSAPGTSESATPESGP<br>GSEPATSGSETPGTSTEPSEGSAPGTSTEPSEGSAPGTSESATPESGPGTSESATPESGPGSPAGSPTSTE<br>EGTSESATPESGPGSEPATSGSETPGTSESATPESGPGTSTEPSEGSAPGTSTEPSEGSAPGTSTEPSEGS<br>APGTSTEPSEGSAPGTSTEPSEGSAPGTSTEPSEGSAPGSPAGSPTSTEEGTSTEPSEGSAPGTSESATPE<br>SGPGSEPATSGSETPGTSESATPESGPGSEPATSGSETPGTSESATPESGPGTSTEPSEGSAPGTSESATP<br>ESGPGSPAGSPTSTEEGSPAGSPTSTEEGSPAGSPTSTEEGTSESATPESGPGTSTEPSEGSAPGTSESAT<br>PESGPGSEPATSGSETPGTSESATPESGPGSEPATSGSETPGTSESASPESGPGTSTEPSEGSAPGSPAGS<br>PTSTEEGTSESATPESGPGSEPATSGSETPGTSESATPESGPGSPAGSPTSTEEGSPAGSPTSTEEGTSTE<br>PSEGSAPGTSESATPESGPGTSESAT |
| 39 | ASSPAGSPTSTESGTSESATPESGPGTSTEPSEGSAPGTSESATPESGPGSEPATSGSETPGTSESATPES<br>GPGSTPAESGGSETPGTSESATPESGPGTSTEPSEGSAPGSPAGSPTSTEEGTSESATPESGPGEEPATSGS<br>TPEGTSESATPESGPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEPSEGSAPGTSTEPS<br>EGSAPGGSAPEAGRSANHTPAGLTGPATSGSETPGTDIQMTQSPSSLSASVGDRVTITCRASQDVNTAVAW<br>YQQKPGKAPKLLIYSASFLYSGVPSRFSGSRSGTDFTLTISSLQPEDFATYYCQQHYTTPPTFGQGTKVEI<br>KGATPPETGAETESPGETTGGSAESEPPGEGEVQLVESGGGLVQPGGSLRLSCAASGFNIKDTYIHWVRQA<br>PGKGLEWVARIYPTNGYTRYADSVKGRFTISADTSKNTAYLQMNSLRAEDTAVYYCSRWGGDGFYAMDYWG<br>QGTLVTVSSGGGSELVVTQEPSLTVSPGGTVTLTCRSSNGAVTSSNYANWVQQKPGQAPRGLIGGTNKRAP<br>GTPARFSGSLLGGKAALTLSGVQPEDEAVYYCALWYPNLWVFGGGTKLTVLGATPPETGAETESPGETTGG<br>SAESEPPGEGEVQLLESGGGIVQPGGSLKLSCAASGFTFNTYAMNWVRQAPGKGLEWVARIRSKYNNYATY<br>YADSVKDRFTISRDDSKNTVYLQMNNLKTEDTAVYYCVRHENFGNSYVSWFAHWGQGTLVTVSSGTAEAAS<br>ASGEAGRSANHTPAGLTGPSAGSPGSPAGSPTSTEEGTSESATPESGPGTSTEPSEGSAPGSPAGSPTSTE<br>EGTSTEPSEGSAPGTSTEPSEGSAPGTSESATPESGPGSEPATSGSETPGSEPATSGSETPGSPAGSPTST<br>EEGTSESATPESGPGTSTEPSEGSAPGTSTEPSEGSAPGSPAGSPTSTEEGTSTEPSEGSAPGTSTEPSEG<br>SAPGTSESATPESGPGTSTEPSEGSAPGTSESATPESGPGSEPATSGSETPGTSTEPSEGSAPGTSTEPSE<br>GSAPGTSESATPESGPGTSESATPESGPGSPAGSPTSTEEGTSESATPESGPGSEPATSGSETPGTSESAT<br>PESGPGTSTEPSEGSAPGTSTEPSEGSAPGTSTEPSEGSAPGTSTEPSEGSAPGTSTEPSEGSAPGTSTEP<br>SEGSAPGSPAGSPTSTEEGTSTEPSEGSAPGTSESATPESGPGSEPATSGSETPGTSESATPESGPGSEPA<br>TSGSETPGTSESATPESGPGTSTEPSEGSAPGTSESATPESGPGSPAGSPTSTEEGSPAGSPTSTEEGSPA |

TABLE D-continued

Exemplary amino acid sequences of polypeptides

| SEQ ID NO. | Amino Acid Sequences |
|---|---|
|  | GSPTSTEEGTSESATPESGPGTSTEPSEGSAPGTSESATPESGPGSEPATSGSETPGTSESATPESGPGSE<br>PATSGSETPGTSESATPESGPGTSTEPSEGSAPGSPAGSPTSTEEGTSESATPESGPGSEPATSGSETPGT<br>SESATPESGPGSPAGSPTSTEEGSPAGSPTSTEEGTSTEPSEGSAPGTSESATPESGPGTSESATPESGPG<br>TSESATPESGPGSEPATSGSETPGSEPATSGSETPGSPAGSPTSTEEGTSTEPSEGSAPGTSTEPSEGSAP<br>GSEPATSGSETPGTSESATPESGPGTSTEPSEGSAPGSPAGSPTSTEEGTSESATPESGPGTSTEPSEGSA<br>PGSPAGSPTSTEEGTSTEPSEGSAPGTSTEPSEGSAPGTSESATPESGPGSEPATSGSETPGSEPATSGST<br>ETPGSPAGSPTSTEEGTSESATPESGPGTSTEPSEGSAPGTSTEPSEGSAPGSPAGSPTSTEEGTSTEPSE<br>GSAPGTATESPEGSAPGTSESATPESGPGTSTEPSEGSAPGTSAESATPESGPGSEPATSGSETPGTSTEP<br>SEGSAPGTSTEPSEGSAPGTSESATPESGPGTESAS |
| 40 | ASSPAGSPTSTESGTSESATPESGPGTSTEPSEGSAPGTSESATPESGPGSEPATSGSETPGTSESATPES<br>GPGSTPAESGGSETPGTSESATPESGPGTSTEPSEGSAPGSPAGSPTSTEEGTSESATPESGPGSEPATSGS<br>ETPGTSESATPESGPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEPSEGSAPGTSTEPS<br>EGSAPGGSAPASTRGENAGPAGLEAPATSGSETPGTDIQMTQSPSSLSASVGDRVTITCKASQDVSIGVAW<br>YQQKPGKAPKLLIYSASYRYTGVPSRFSGSGSGTDFTLTISSLQPEDFATYYCQQYYTYPYTFGQGTKVEI<br>KGATPPETGAETESPGETTGGSAESEPPGEGEVQLVESGGGLVQPGGSLRLSCAASGFTFTDYTMDWVRQA<br>PGKGLEWVADVNPNSGGSIYNQRFKGRFTLSVDRSKNTLYLQMNSLRAEDTAVYYCARNLGPSFYFDYWGQ<br>GTLVTVSSGGGSELVVTQEPSLTVSPGGTVTLTCRSSTGAVTTSNYANWVQQKPGQAPRGLIGGTNKRAPG<br>TPARFSGSSLGGSAALTLSGVQPEDEAEYYCALWYSNLWVFGGGTKLTVLGATPPETGAETESPGETTGGS<br>AESEPPGEGEVQLQESGGGLVQPGGSLKLSCAASGFTFNTYAMNWVRQAPGKGLEWVARIRSKYNNYATYY<br>ADSVKDRFTISRDDSKNTAYLQMNNLKTEDTAVYYCVRHGNFGNSYVSWFAYWGQGTLVTVSSGTAEAASA<br>SGASTRGENAGPAGLEAPPGSPAGSPTSTEEGTSESATPESGPGTSTEPSEGSAPGSPAGSPTSTEEGTST<br>EPSEGSAPGTSTEPSEGSAPGTSESATPESGPGSEPATSGSETPGSEPATSGSETPGSPAGSPTSTEEGTS<br>ESATPESGPGTSTEPSEGSAPGTSTEPSEGSAPGSPAGSPTSTEEGTSTEPSEGSAPGTSTEPSEGSAPGT<br>SESATPESGPGTSTEPSEGSAPGTSESATPESGPGSEPATSGSETPGTSTEPSEGSAPGTSTEPSEGSAPG<br>TSESATPESGPGTSESATPESGPGSPAGSPTSTEEGTSESATPESGPGSEPATSGSETPGTSESATPESGP<br>GTSTEPSEGSAPGTSTEPSEGSAPGTSTEPSEGSAPGTSTEPSEGSAPGTSTEPSEGSA<br>PGSPAGSPTSTEEGTSTEPSEGSAPGTSESATPESGPGSEPATSGSETPGTSESATPESGPGSEPATSGSE<br>TPGTSESATPESGPGTSTEPSEGSAPGTSESATPESGPGSPAGSPTSTEEGSPAGSPTSTEEGSPAGSPTS<br>TEEGTSESATPESGPGTSTEPSEGSAPGTSESATPESGPGSEPATSGSETPGTSESATPESGPGSEPATSG<br>SETPGTSESATPESGPGTSTEPSEGSAPGSPAGSPTSTEEGTSESATPESGPGSEPATSGSETPGTSESAT<br>PESGPGSPAGSPTSTEEGSPAGSPTSTEEGTSTEPSEGSAPGTSESATPESGPGTSESATPESGPGftabT<br>SESATPESGPGSEPATSGPTESGSEPATSGSETPGSPAGSPTSTEEGTSTEPSEGSAPGTESTPSEGSAPG<br>SEPATSGSETPGTSESATPESGPGTSTEPSEGSAPGEPEA |
| 41 | GSPAGSPTSTEEGTSESATPESGPGTSTEPSEGSAPGSPAGSPTSTEEGTSTEPSEGSAPGTSTEPSEGSA<br>PGTSESATPESGPGSESATSGSETPGSEPATSGSETPGSPAGSPTSTEEGTSESATPESGPGTSTEPSEGS<br>APGTSTEPSEGSAPGSPAGSPTSTEEGTSTEPSEGSAPGTSTEPSEGSAPGTSESATPESGPGTSTEPSEG<br>SAPGTSESATPESGPGSEPATSGSETPGTSTEPSEGSAPGTSTEPSEGSAPGTSESATPESGPGTSESATP<br>ESGPGSPAGSPTSTEEGTSESATPESGPGSEPATSGSETPGTSTEPSEGSPGTSTEPSEGSAPGTSTEPS<br>EGSAPGTSTEPSEGSAPGTSTEPSEGSAPGTSTEPSEGSAPGTSTEPSEGSAPGSPAGSPTSTEEGTSTEP<br>SEGSAPGTSESATPESGPGSEPATSGSETPGTSESATPESGPGSEPATSGSETPGTSESATPESGPGTSTE<br>PSEGSAPGTSESATPESGPGSPAGSPTSTEEGSPAGSPTSTEEGSPAGSPTSTEEGTSESATPESGPGTST<br>EPSEGSAPGTSESATPESGPGSEPATSGSETPGTSESATPESGPGSEPATSGSETPGTSESATPESGPGTS<br>TEPSEGSAPGSPAGSPTSTEEGTSESATPESGPGSEPATSGSETPGTSESATPESGPGSPAGSPTSTEEGS<br>PAGSPTSTEEGTSTEPSEGSAPGTSESATPESGPGTSESATPESGPGTSESATPESGPGSEPATSGSETPG<br>SEPATSGSETPGSPAGSPTSTEEGTSTEPSEGSAPGTSTEPSEGSAPGSEPATSGSETPGTSESATPESGP<br>GTSTEPSEGSAPPTGRSGEGANATPSGLTGPATSGSETPGTEIVLTQSPATLSLSPGERATLSCKASQDVS<br>IGVAWYQQKPGQAPRLLIYSASYRYSGVPARFSGSGSGTDFTLTISSLEPEDFAVYYCQQYYTYPYTFGQG<br>TKVEIKGATPPETGAETESPGETTGGSAESEPPGEGQVQLVQSGVEVKKPGASVKVSCKASGFTFTDYTMD<br>WVRQAPGQGLEWMADVNPNSGGSIYNQRFKGRVTLTTDSSTTTAYMELKSLQFDDTAVYYCARNLGPSFYF<br>DYWGQGTLVTVSSGGGSELVVTQEPSLTVSPGGTVTLTCRSSNGAVTSSNYANWVQQKPGQAPRGLIGGTN<br>KRAPGTPARFSGSSLGGKAALTLSGVQPEDEAVYYCALWYPNLWVFGGGTKLTVLGATPPETGAETESPGE<br>TTGGSAESEPPGEGEVQLQESGGGIVQPGGSLKLSCAASGFTFNTYAMNWVRQAPGKGLEWVARIRSKYNN<br>YATYYADSVKDRFTISRDDSKNTVYLQMNNLKTEDTAVYYCVRHENFGNSYVSWFAHWGQGTLVTVSSGTA<br>EAASASGPTGRSGEGANATPSGLTGPPGSPAGSPTSTEEGTSESATPESGPGSEPATSGSETPGTSESATP<br>ESGPGTSTEPSEGSAPGTSTEPSEGSAPGTSTEPSEGSAPGTSTEPSEGSAPGTSTEPSEGSAPGTS<br>EGSAPGSPAGSPTSTEEGTSTEPSEGSAPGTSESATPESGPGSEPATSGSETPGTSESATPESGPGSEPAT<br>SGSETPGTSESATPESGPGTSTEPSEGSAPGTSESATPESGPGSPAGSPTSTEEGSPAGSPTSTEEGSPAG<br>SPTSTEEGTSESATPESGPGTSTEPSEGSAPGTSESATPESGPGSEPATSGSETPGTSESATPESGPGSEP<br>ATSGSETPGTSESATPESGPGTSTEPSEGSAPGSPAGSPTSTEEGTSESATPESGPGSEPATSGSETPGTS<br>ESATPESGPGSPAGSPTSTEEGSPAGSPTSTEEGTSTEPSEGSAPGTSESATPESGPGTSESATPESGPGT<br>SESATPESGPGSEPATSGSETPGSEPATSGSETPGSPAGSPTSTEEGTSTEPSEGSAPGTESTPSEGSAPG<br>SEPATSGSETPGTSESATPESGPGTSTEPSEGSAPG |
| 42 | SPAGSPTSTESGTSESATPESGPGTSTEPSEGSAPGTSESATPESGPGSEPATSGSETPGTSESATPESGP<br>GSTPAESGSETPGTSESATPESGPGTSTEPSEGSAPGSPAGSPTSTEEGTSESATPESGPGSEPATSGSET<br>PGTSESATPESGPGSPAGSPTSTEEGSPAGSPTSTEEGTSTEPSEGSAPGTSESATPESGPGTSESATPES<br>GPGTSESATPESGPGSEPATSGSETPGSEPATSGSETPGSPAGSPTSTEEGTSTEPSEGSAPGTSTEPSEG<br>SAPGGSAPRTGRTGESANETPAGLGGPATSGSETPGTDIQMTQSPSSLSASVGDRVTITCKASQDVSIGVA<br>WYQQKPGKAPKLLIYSASYRYTGVPSRFSGSGSGTDFTLTISSLQPEDFATYYCQQYYIYPYTFGQGTKVE<br>IKGATPPETGAETESPGETTGGSAESEPPGEGEVQLVESGGGLVQPGGSLRLSCAASGFTFTDYTMDWVRQ<br>APGKGLEWVADVNPNSGGSIYNQRFKGRFTLSVDRSKNTLYLQMNSLRAEDTAVYYCARNLGPSFYDYWG<br>QGTLVTVSSGGGSELVVTQEPSLTVSPGGTVTLTCRSSNGAVTSSNYANWVQQKPGQAPRGLIGGTNKRAP |

TABLE D-continued

Exemplary amino acid sequences of polypeptides

| SEQ ID NO. | Amino Acid Sequences |
|---|---|
| | GTPARFSGSLLGGKAALTLSGVQPEDEAVYYCALWYPNLWVFGGGTKLTVLGATPPETGAETESPGETTGG<br>SAESEPPGEGEVQLLESGGGIVQPGGSLKLSCAASGFTFNTYAMNWVRQAPGKGLEWVARIRSKYNNYATY<br>YADSVKDRFTISRDDSKNTVYLQMNNLKTEDTAVYYCVRHENFGNSYVSWFAHWGQGTLVTVSSGTAEAAS<br>ASGRTGRTGESANETPAGLGGPPGSPAGSPTSTEEGTSESATPESGPGSEPATSGSETPGTSESATPESGP<br>GTSTEPSEGSAPGTSTEPSEGSAPGTSTEPSEGSAPGTSTEPSEGSAPGTSTEPSEGSA<br>PGSPAGSPTSTEEGTSTEPSEGSAPGTSESATPESGPGSEPATSGSETPGTSESATPESGPGSEPATSGSE<br>TPGTSESATPESGPGTSTEPSEGSAPGTSESATPESGPGSPAGSPTSTEEGSPAGSPTSTEEGSPAGSPTS<br>TEEGTSESATPESGPGTSTEPSEGSAPGTSESATPESGPGSEPATSGSETPGTSESATPESGPGSEPATSG<br>SETPGTSESATPESGPGTSTEPSEGSAPGSPAGSPTSTEEGTSESATPESGPGSEPATSGSETPGTSESAT<br>PESGPGSPAGSPTSTEEGSPAGSPTSTEEGTSTEPSEGSAPGTSESATPESGPGTSESATPESGPGTSESA<br>TPESGPGSEPATSGSETPGSEPATSGSETPGSPAGSPTSTEEGTSTEPSEGSAPGTESTPSEGSAPGSEPA<br>TSGSETPGTSESATPESGPGTSTEPSEGSAPGEPEA |
| 43 | ASSPAGSPTSTESGTSESATPESGPGTSTEPSEGSAPGTSESATPESGPGSEPATSGSETPGTSESATPES<br>GPGSTPAESGSETPGTSESATPESGPGTSTEPSEGSAPGSPAGSPTSTEEGTSESATPESGPGSEPATSGS<br>ETPGTSESATPESGPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEPSEGSAPGTSTEPS<br>EGSAPGGSAPTTARAGSAENLSPSGLTGPATSGSETPGTDIQMTQSPSSLSASVGDRVTITCRASQDVNTA<br>VAWYQQKPGKAPKLLIYSASFLYSGVPSRFSGSRSGTDFTLTISSLQPEDFATYYCQQHYTTPPTFGQGTK<br>VEIKGATPPETGAETESPGETTGGSAESEPPGEGEVQLVESGGGLVQPGGSLRLSCAASGFNIKDTYIHWV<br>RQAPGKGLEWVARIYPTNGYTRYADSVKGRFTISADTSKNTAYLQMNSLRAEDTAVYYCSRWGGDGFYAMD<br>YWGQGTLVTVSSGGGSELVVTQEPSLTVSPGGTVTLTCRSSTGAVTTSNYANWVQQKPGQAPRGLIGGTNK<br>RAPGTPARFSGSLLGGKAALTLSGVQPEDEAEYYCALWYSNLWVFGGGTKLTVLGATPPETGAETESPGET<br>TGGSAESEPPGEGEVQLLESGGGLVQPGGSLKLSCAASGFTFNTYAMNWVRQAPGKGLEWVARIRSKYNNY<br>ATYYADSVKDRFTISRDDSKNTAYLQMNNLKTEDTAVYYCVRHGNFGNSYVSWFAYWGQGTLVTVSSGTAE<br>AASASGTTARAGSAENLSPSGLTGPPGSPAGSPTSTEEGTSESATPESGPGTSTEPSEGSAPGSPAGSPTS<br>TEEGTSTEPSEGSAPGTSTEPSEGSAPGTSESATPESGPGSEPATSGSETPGSEPATSGSETPGSPAGSPT<br>STEEGTSESATPESGPGTSTEPSEGSAPGTSTEPSEGSAPGSPAGSPTSTEEGTSTEPSEGSAPGTSTEPS<br>EGSAPGTSESATPESGPGTSTEPSEGSAPGTSESATPESGPGSEPATSGSETPGTSTEPSEGSAPGTSTEP<br>SEGSAPGTSESATPESGPGTSTEPSEGSAPGTSESATPESGPGSPAGSPTSTEEGTSESATPESGPGSEPATSGSETPGTSES<br>ATPESGPGTSTEPSEGSAPGTSTEPSEGSAPGTSTEPSEGSAPGTSTEPSEGSAPGTSTEPSEGSAPGTST<br>EPSEGSAPGSPAGSPTSTEEGTSTEPSEGSAPGTSESATPESGPGSEPATSGSETPGTSESATPESGPGSE<br>PATSGSETPGTSESATPESGPGTSTEPSEGSAPGTSESATPESGPGSPAGSPTSTEEGSPAGSPTSTEEGS<br>PAGSPTSTEEGTSESATPESGPGTSTEPSEGSAPGTSESATPESGPGSEPATSGSETPGTSESATPESGPG<br>SEPATSGSETPGTSESATPESGPGTSTEPSEGSAPGSPAGSPTSTEEGTSESATPESGPGSEPATSGSETP<br>GTSESATPESGPGSPAGSPTSTEEGSPAGSPTSTEEGTSTEPSEGSAPGTSESATPESGPGTSESATPESG<br>PGTSESATPESGPGSEPATSGSETPGSEPATSGSETPGSPAGSPTSTEEGTSTEPSEGSAPGTESTPSEGS<br>APGSEPATSGSETPGTSESATPESGPGTSTEPSEGSAPG |
| 44 | ASSPAGSPTSTESGTSESATPESGPGTSTEPSEGSAPGTSESATPESGPGSEPATSGSETPGTSESATPES<br>GPGSTPAESGSETPGTSESATPESGPGTSTEPSEGSAPGSPAGSPTSTEEGTSESATPESGPGEEPATSGS<br>TPEGTSESATPESGPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEPSEGSAPGTSTEPS<br>EGSAPGGSAPLGGRADNHEPPELGAGATSGSETPGTDIQMTQSPSSLSASVGDRVTITCKASQDVSIGVAW<br>YQQKPGKAPKLLIYSASYRYTGVPSRFSGSGSGTDFTLTISSLQPEDFATYYCQQYYTYPYTFGQGTKVEI<br>KGATPPETGAETESPGETTGGSAESEPPGEGEVQLVESGGGLVQPGGSLRLSCAASGFTFTDYTMDWVRQA<br>PGKGLEWVADVNPNSGGSIYNQRFKGRFTLSVDRSKNTLYLQMNSLRAEDTAVYYCARNLGPSFYFDYWGQ<br>GTLVTVSSGGGSELVVTQEPSLTVSPGGTVTLTCRSSNGAVTSSNYANWVQQKPGQAPRGLIGGTNKRAPG<br>TPARFSGSSLGGKAALTLSGVQPEDEAVYYCALWYPNLWVFGGGTKLTVLGATPPETGAETESPGETTGGS<br>AESEPPGEGEVQLQESGGGIVQPGGSLKLSCAASGFTFNTYAMNWVRQAPGKGLEWVARIRSKYNNYATYY<br>ADSVKDRFTISRDDSKNTVYLQMNNLKTEDTAVYYCVRHENFGNSYVSWFAHWGQGTLVTVSSGTAEAASA<br>SGLGGRADNHEPPELGAGTPESGPGTSESATPESGPGSPAGSPTSTEEGTSESATPESGPGSEPATSGSET<br>PGTSESATPESGPGTSTEPSEGSAPGTSTEPSEGSAPGTSTEPSEGSAPGTSTEPSEGSAPGTSTEPSEGS<br>APGTSTEPSEGSAPGSPAGSPTSTEEGTSTEPSEGSAPGTSESATPESGPGSEPATSGSETPGTSESATPE<br>SGPGSEPATSGSETPGTSESATPESGPGTSTEPSEGSAPGTSESATPESGPGSPAGSPTSTEEGSPAGSPT<br>STEEGSPAGSPTSTEEGTSESATPESGPGTSTEPSEGSAPGTSESATPESGPGSEPATSGSETPGTSESAT<br>PESGPGSEPATSGSETPGTSESATPESGPGTSTEPSEGSAPGSPAGSPTSTEEGTSESATPESGPGSEPAT<br>SGSETPGTSESATPESGPGSPAGSPTSTEEGSPAGSPTSTEEGTSTEPSEGSAPGTSESATPESGPGTSES<br>ATPESGPGTSESATPESGPGSEPATSGSETPGSEPATSGSETPGSPAGSPTSTEEGTSTEPSEGSAPGTST<br>EPSEGSAPGSEPATSGSETPGTSESA |
| 45 | SPAGSPTSTESGTSESATPESGPGTSTEPSEGSAPGTSESATPESGPGSEPATSGSETPGTSESATPESGP<br>GSTPAESGSETPGTSESATPESGPGTSTEPSEGSAPGSPAGSPTSTEEGTSESATPESGPGSEPATSGSET<br>PGTSESATPESGPGSPAGSPTSTEEGSPAGSPTSTEEGTSTEPSEGSAPGTSESATPESGPGTSESATPES<br>GPGTSESATPESGPGSEPATSGSETPGSEPATSGSETPGSPAGSPTSTEEGTSTEPSEGSAPGTSTEPSEG<br>SAPGGSAPTTGRAGEAEGATSAGATGPATSGSETPGTDIQMTQSPSSLSASVGDRVTITCRASQDVNTAVA<br>WYQQKPGKAPKLLIYSASFLYSGVPSRFSGSRSGTDFTLTISSLQPEDFATYYCQQHYTTPPTFGQGTKVE<br>IKGATPPETGAETESPGETTGGSAESEPPGEGEVQLVESGGGLVQPGGSLRLSCAASGFNIKDTYIHWVRQ<br>APGKGLEWVARIYPTNGYTRYADSVKGRFTISADTSKNTAYLQMNSLRAEDTAVYYCSRWGGDGFYAMDYW<br>GQGTLVTVSSGGGSELVVTQEPSLTVSPGGTVTLTCRSSTGAVTTSNYANWVQQKPGQAPRGLIGGTNKRA<br>PGTPARFSGSSLGGSAALTLSGVQPEDEAEYYCALWYSNLWVFGGGTKLTVLGATPPETGAETESPGETTG<br>GSAESEPPGEGEVQLQESGGGLVQPGGSLKLSCAASGFTFNTYAMNWVRQAPGKGLEWVARIRSKYNNYAT<br>YYADSVKDRFTISRDDSKNTAYLQMNNLKTEDTAVYYCVRHGNFGNSYVSWFAYWGQGTLVTVSSGTAEAA<br>SASGTTGRAGEAEGATSAGATGPEGSAPGTSTEPSEGSAPGTSESATPESGPGTSTEPSEGSAPGTSESAT<br>PESGPGSEPATSGSETPGTSTEPSEGSAPGTSTEPSEGSAPGTSESATPESGPGTSESATPESGPGSPAGS |

TABLE D-continued

Exemplary amino acid sequences of polypeptides

| SEQ ID NO. | Amino Acid Sequences |
|---|---|
| | PTSTEEGTSESATPESGPGSEPATSGSETPGTSESATPESGPGTSTEPSEGSAPGTSTEPSEGSAPGTSTE<br>PSEGSAPGTSTEPSEGSAPGTSTEPSEGSAPGTSTEPSEGSAPGSPAGSPTSTEEGTSTEPSEGSAPGTSE<br>SATPESGPGSEPATSGSETPGTSESATPESGPGSEPATSGSETPGTSESATPESGPGTSTEPSEGSAPGTS<br>ESATPESGPGSPAGSPTSTEEGSPAGSPTSTEEGSPAGSPTSTEEGTSESATPESGPGTSTEPSEGSAPGT<br>SESATPESGPGSEPATSGSETPGTSESATPESGPGSEPATSGSETPGTSESASPESGPGTSTEPSEGSAPG<br>SPAGSPTSTEEGTSESATPESGPGSEPATSGSETPGTSESATPESGPGSPAGSPTSTEEGSPAGSPTSTEE<br>GTSTEPSEGSAPGTSESATPESGPGTSESAT |
| 46 | SAGSPGSPAGSPTSTEEGTSESATPESGPGTSTEPSEGSAPGSPAGSPTSTEEGTSTEPSEGSAPGTSTEP<br>SEGSAPGTSESATPESGPGSTPAESGSETPGSEPATSGSETPGSPAGSPTSTEEGTSESATPESGPGTSTE<br>PSEGSAPGTSTEPSEGSAPGSPAGSPTSTEEGTSTEPSEGSAPGTSTEPSEGSAPGTSESATPESGPGTST<br>EPSEGSAPGTSESATPESGPGSEPATSGSTETPGTSTEPSEGSAPGTSTEPSEGSAPGTSESATPESGPGT<br>SESATPESGPGSPAGSPTSTEEGTSESATPESGPGSEPATSGSETPGTSESATPESGPGTSTEPSEGSAPG<br>TSTEPSEGSAPGTSTEPSEGSAPGTSTEPSEGSAPGTSTEPSEGSAPGTSTEPSEGSAPGSPAGSPTSTEE<br>GTSTEPSEGSAPGTSESATPESGPGSEPATSGSETPGTSESATPESGPGSEPATSGSETPGTSESATPESG<br>PGTSTEPSEGSAPGTSESATPESGPGSPAGSPTSTEEGSPAGSPTSTEEGSPAGSPTSTEEGTSESATPES<br>GPGTSTEPSEGSAPGTSESATPESGPGSEPATSGSETPGTSESATPESGPGSEPATSGSETPGTSESATPE<br>SGPGTSTEPSEGSAPGSPAGSPTSTEEGTSESATPESGPGSEPATSGSETPGTSESATPESGPGSPAGSPT<br>STEEGSPAGSPTSTEEGTSTEPSEGSAPGTSESATPESGPGTSESATPESGPGTSESATPESGPGSEPATS<br>GSETPGSEPATSGSETPGSPAGSPTSTEEGTSTEPSEGSAPGTSTEPSEGSAPGSEPATSGSETPGTSESA<br>TPESGPGTSTEPSEGSAPGSPAGSPTSTEEGTSESATPESGPGTSTEPSEGSAPGSPAGSPTSTEEGTSTE<br>PSEGSAPGTSTEPSEGSAPGTSESATPESGPGSEPATSGSETPGSEPATSGSETPGSPAGSPTSTEEGTSE<br>SATPESGPGTSTEPSEGSAPGTSTEPSEGSAPGSPAGSPTSTEEGTSTEPSEGSAPGTSTEPSEGSAPGTS<br>ESATPESGPGTSTEPSEGSAPGTSESATPESGPGSEPATSGSETPGTSTEPSEGSAPGTSTEPSEGSAPGT<br>SESATPESGPGTSESASTTGRAGEAANATSAGATGPATSGSETPGTDIQMTQSPSSLSASVGDRVTITCRAS<br>QDVNTAVAWYQQKPGKAPKLLIYSASFLYSGVPSRFSGSRSGTDFTLTISSLQPEDFATYYCQQHYTTPPT<br>FGQGTKVEIKGATPPETGAETESPGETTGGSAESEPPGEGEVQLVESGGGLVQPGGSLRLSCAASGFNIKD<br>TYIHWVRQAPGKGLEWVARIYPTNGYTRYADSVKGRFTISADTSKNTAYLQMNSLRAEDTAVYYCSRWGGD<br>GFYAMDYWGQGTLVTVSSGGGSELVVTQEPSLTVSPGGTVTLTCRSSTGAVTTSNYANWVQQKPGQAPRGL<br>IGGTNKRAPGTPARFSGSLLGGKAALTLSGVQPEDEAEYYCALWYSNLWVFGGGTKLTVLGATPPETGAET<br>ESPGETTGGSAESEPPGEGEVQLLESGGGLVQPGGSLKLSCAASGFTFNTYAMNWVRQAPGKGLEWVARIR<br>SKYNNYATYYADSVKDRFTISRDDSKNTAYLQMNNLKTEDTAVYYCVRHGNFGNSYVSWFAYWGQGTLVTV<br>SSGTAEAASASGTTGRAGEAANATSAGATGPPGSPAGSPTSTEEGTSESATPESGPGTSTEPSEGSAPGSP<br>AGSPTSTEEGTSTEPSEGSAPGTSTEPSEGSAPGTSESATPESGPGSEPATSGSETPGSEPATSGSETPGS<br>PAGSPTSTEEGTSESATPESGPGTSTEPSEGSAPGTSTEPSEGSAPGSPAGSPTSTEEGTSTEPSEGSAPG<br>TSTEPSEGSAPGTSESATPESGPGTSTEPSEGSAPGTSESATPESGPGSEPATSGSETPGTSTEPSEGSAP<br>GTSTEPSEGSAPGTSESATPESGPGTSESATPESGPGSPAGSPTSTEEGTSESATPESGPGSEPATSGSET<br>PGTSESATPESGPGTSTEPSEGSAPGTSTEPSEGSAPGTSTEPSEGSAPGTSTEPSEGSAPGTSTEPSEGS<br>APGTSTEPSEGSAPGSPAGSPTSTEEGTSTEPSEGSAPGTSESATPESGPGSEPATSGSETPGTSESATPE<br>SGPGSEPATSGSETPGTSESATPESGPGTSTEPSEGSAPGTSESATPESGPGSPAGSPTSTEEGSPAGSPT<br>STEEGSPAGSPTSTEEGTSESATPESGPGTSTEPSEGSAPGTSESATPESGPGSEPATSGSETPGTSESAT<br>PESGPGSEPATSGSETPGTSESATPESGPGTSTEPSEGSAPGSPAGSPTSTEEGTSESATPESGPGSEPAT<br>SGSETPGTSESATPESGPGSPAGSPTSTEEGSPAGSPTSTEEGTSTEPSEGSAPGTSESATPESGPGTSES<br>ATPESGPGftabTSESATPESGPGSEPATSGPTESGSEPATSGSETPGSPAGSPTSTEEGTSTEPSEGSAP<br>GTESTPSEGSAPGSEPATSGSETPGTSESATPESGPGTSTEPSEGSAPGEPEA |
| 47 | ASSPAGSPTSTESGTSESATPESGPGTETEPSEGSAPGTSESATPESGPGSEPATSGSETPGTSESATPES<br>GPGSTPAESGSETPGTSESATPESGPGTSTEPSEGSAPGSPAGSPTSTEEGTSESATPESGPGESPATSGS<br>TPEGTSESATPESGPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEPSEGSAPGTSTEPS<br>EGSAPGGSAPTTGRATEAANATPAGLTGPATSGSETPGTEIVLTQSPATLSLSPGERATLSCKASQDVSIG<br>VEIKGATPPETGAETESPGETTGGSAESEPPGEGQVQLVQSGVEVKKPGASVKVSCKASGFTFTDYTMDWV<br>VAWYQQKPGQAPRLLIYSASYRYSGVPARFSGSGSGTDFTLTISSLEPEDFAVYYCQQYYIYPYTFGQGTK<br>RQAPGQGLEWMADVNPNSGGSIYNQRFKGRVTLTTDSSTTTAYMELKSLQFDDTAVYYCARNLGPSFYFDY<br>WGQGTLVTVSSGGGSELVVTQEPSLTVSPGGTVTLTCRSSNGAVTSSNYANWVQQKPGQAPRGLIGGTNKR<br>APGTPARFSGSLLGGKAALTLSGVQPEDEAVYYCALWYPNLWVFGGGTKLTVLGATPPETGAETESPGETT<br>GGSAESEPPGEGEVQLLESGGGIVQPGGSLKLSCAASGFTFNTYAMNWVRQAPGKGLEWVARIRSKYNNYA<br>TYYADSVKDRFTISRDDSKNTVYLQMNNLKTEDTAVYYCVRHENFGNSYVSWFAHWGQGTLVTVSSGTAEA<br>ASASGTTGRATEAANATPAGLTGPPGSPAGSPTSTEEGTSESATPESGPGSEPATSGSETPGTSESATPES<br>GPGTSTEPSEGSAPGTSTEPSEGSAPGTSTEPSEGSAPGTSTEPSEGSAPGTSTEPSEGSAPGTSTEPSEG<br>SAPGSPAGSPTSTEEGTSTEPSEGSAPGTSESATPESGPGSEPATSGSETPGTSESATPESGPGSEPATSG<br>SETPGTSESATPESGPGTSTEPSEGSAPGTSESATPESGPGSPAGSPTSTEEGSPAGSPTSTEEGSPAGSP<br>TSTEEGTSESATPESGPGTSTEPSEGSAPGTSESATPESGPGSEPATSGSETPGTSESATPESGPGSEPAT<br>SGSETPGTSESATPESGPGTSTEPSEGSAPGSPAGSPTSTEEGTSESATPESGPGSEPATSGSETPGTSES<br>ATPESGPGSPAGSPTSTEEGSPAGSPTSTEEGTSTEPSEGSAPGTSESATPESGPGTSESATPESGPGTSE<br>SATPESGPGSEPATSGSETPGSEPATSGSETPGSPAGSPTSTEEGTSTEPSEGSAPGTSESTPSEGSAPGSE<br>PATSGSETPGTSESATPESGPGTSTEPSEGSAPGEPEA |

Polypeptide Mixture

Disclosed herein includes a mixture comprising a plurality of polypeptides of varying length; the mixture comprising a first set of polypeptides and a second set of polypeptides. In some embodiments, each polypeptide of the first set of polypeptides comprises a barcode fragment that (a) is releasable from the polypeptide by digestion with a protease and (b) has a sequence and molecular weight that differs from the sequence and molecular weight of all other fragments that are releasable from the first set of polypeptides.

In some embodiments, the second set of polypeptides lack the barcode fragment of the first set of polypeptides (e.g., due to truncation). In some embodiments, both the first set of polypeptides and the second set of polypeptides each comprise a reference fragment that (a) is common to the first set of polypeptides and the second set of polypeptides and (b) releasable by digestion with the protease. In some embodiments, the ratio of the first set of polypeptides to polypeptides comprising the reference fragment is greater than 0.70. In some embodiments, the ratio of the first set of polypeptides to polypeptides comprising the reference fragment is greater than 0.80, 0.90, 0.95, or 0.98. In some embodiments, the reference fragment occurs no more than once in each polypeptide of the first set of polypeptides and the second set of polypeptides. In some embodiments, the protease is a protease that cleaves on the C-terminal side of glutamic acid residues. In some embodiments, the protease is a Glu-C protease. In some embodiments, the protease is not trypsin. In some embodiments, the polypeptides of varying lengths comprise polypeptides comprising at least one extended recombinant polypeptide (XTEN), such as any described hereinabove or described anywhere else herein. In some embodiments, the first set of polypeptides comprises a full-length polypeptide, wherein the barcode fragment is a portion of the full-length polypeptide. In some embodiments, the full-length polypeptide is a (fusion) polypeptide, such as any described hereinabove or described anywhere else herein. In some embodiments, the barcode fragment lacks (does not comprise) both the N-terminal amino acid and C-terminal amino acid of the full-length polypeptide. In some embodiments, the mixture of polypeptides of varying lengths differ from one another due to N-terminal truncation, C-terminal truncation, or both N- and C-terminal truncation of a full-length polypeptide. In some embodiments, the first set of polypeptides and the second set of polypeptides may differ in one or more pharmacological properties. Non-limiting exemplary properties include.

Method of Polypeptide Characterization

Disclosed herein includes a method for assessing, in a mixture comprising polypeptides of varying length, a relative amount of a first set of polypeptides in the mixture to a second set of polypeptides in the mixture, wherein (1) each polypeptide of the first set of polypeptides shares a barcode fragment that occurs once and only once in the polypeptide and (2) each polypeptide of the second set of polypeptides lacks the barcode fragment that is shared by polypeptides of the first set, wherein individual polypeptides of both the first of polypeptides and the second set of polypeptides each comprises a reference fragment. The method can comprise contacting the mixture with a protease to produce a plurality of proteolytic fragments that result from cleavage of the first set of polypeptides and the second set of polypeptides, wherein the plurality of proteolytic fragments comprise a plurality of reference fragments, and a plurality of barcode fragments. The method can further comprise determining a ratio of the amount of barcode fragments to the amount of reference fragments, thereby assessing the relative amounts of the first set of polypeptides to the second set of polypeptides. In some embodiments, the barcode fragment occurs no more than once in each polypeptide of the first set of polypeptides. In some embodiments, the reference fragment occurs no more than once in each polypeptide of the first set of polypeptides and the second set of polypeptides. In some embodiments, the plurality of proteolytic fragments comprises a plurality of reference fragments, and a plurality of barcode fragments. In some embodiments, the protease cleaves the first and second sets of polypeptides (or the polypeptides of varying length) on the C-terminal side of glutamic acid residues that are not followed by a proline residue. In some embodiments, the protease is a Glu-C protease. In some embodiments, the protease is not trypsin. In some embodiments, the step of determining a ratio of the amount of barcode fragments to the amount of reference fragments comprises identifying barcode fragments and reference fragments from the mixture after it has been contacted with the protease. In some embodiments, the barcode fragments and the reference fragments are identified based on their respective masses. In some embodiments, the barcode fragments and the reference fragments are identified via mass spectrometry. In some embodiments, the barcode fragments and reference fragments are identified via liquid chromatography-mass spectrometry (LC-MS). In some embodiments, the step of determining a ratio of the barcode fragments to the reference fragments comprises isobaric labeling. In some embodiments, the step of determining a ratio of the barcode fragments to the reference fragments comprises spiking the mixture with one or both of an isotope-labeled reference fragment and an isotope labeled barcode fragment. In some embodiments, the polypeptides of varying lengths comprise polypeptides that comprise at least one extended recombinant polypeptide (XTEN), as described hereinabove or described anywhere else herein. In some embodiments, the XTEN is characterized in that (i) it comprises at least 100, or at least 150 amino acids; (ii) at least 90% of the amino acid residues of the XTEN are glycine (G), alanine (A), serine (S), threonine (T), glutamate (E) or proline (P); and (iii) it comprises at least 4 different types of amino acids that are G, A, S, T, E, or P. In some embodiments, the barcode fragment, when present, is a portion of the XTEN. In some embodiments, the mixture of polypeptides of varying lengths comprises a polypeptide as any described hereinabove or described anywhere else herein. In some embodiments, the polypeptides of varying length comprise a full-length polypeptide and truncated fragments thereof. In some embodiments, the polypeptides of varying length consist essentially of the full-length polypeptide and truncated fragments thereof. In some embodiments, the mixture of polypeptides of varying lengths differ from one another due to N-terminal truncation, C-terminal truncation, or both N- and C-terminal truncation of a full-length polypeptide. In some embodiments, the full-length polypeptide is a polypeptide as described hereinabove or described anywhere else herein. In some embodiments, the ratio of the amount of barcode fragments to reference fragments is greater than 0.50, 0.60, 0.70, 0.80, 0.90, 0.95, 0.98, or 0.99.

Isobaric Labeling-Based Quantification of Peptides

In some embodiments, isobaric labeling can be used for determining a ratio of the barcode fragments to the reference fragments. One of ordinary skill will understand that isobaric labeling is a mass spectrometry strategy used in quantitative proteomics, wherein peptides or proteins (or portions thereof) are labeled with various chemical groups that are isobaric (identical in mass) but vary in terms of distribution of heavy isotopes around their structure. These tags, commonly referred to as tandem mass tags, are designed so that the mass tag is cleaved at a specific linker region upon high-energy collision-induced dissociation (CID) during tandem mass spectrometry, thereby yielding reporter ions of different masses. One of ordinary skill will understand that one of the most common isobaric tags are amine-reactive tags.

The enhanced ability to detect and quantify truncation products (e.g., via isobaric labeling) can generate knowledge than can aid in designing manufacturing processes to include purification steps to minimize the presence of unwanted variants in the purified drug substance/product.

Recombinant Production

The disclosure herein includes a nucleic acid. The nucleic acid can comprise a polynucleotide (or polynucleotide sequence) encoding a (fusion) polypeptide, such as any described hereinabove or described anywhere else herein; or the nucleic acid can comprise the reverse complement of such a polynucleotide (or polynucleotide sequence).

The disclosure herein includes an expression vector that comprises a polynucleotide sequence, such as any described in the preceding paragraph, and a regulatory sequence operably linked to the polynucleotide sequence.

The disclosure herein includes a host cell comprising an expression vector, such as described any in the preceding paragraph. In some embodiments, the host cell is a prokaryote. In some embodiments, the host cell is *E. coli*. In some embodiments, the host cell is a mammalian cell.

In some embodiments, the disclosure provides methods of manufacturing the subject compositions. In one embodiment, the method comprises culturing a host cell comprising a nucleic acid construct that encodes a polypeptide or an XTEN-containing composition of any of the embodiments described herein under conditions that promote the expression of the polypeptide or BPXTEN fusion polypeptide, followed by recovery of the polypeptide or BPXTEN fusion polypeptide using standard purification methods (e.g., column chromatography, HPLC, and the like) wherein the composition is recovered wherein at least 70%, or at least 80%, or at least 90%, or at least 95%, or at least 97%, or at least 99% of the binding fragments of the expressed polypeptide or BPXTEN fusion polypeptide are correctly folded. In some embodiments of the method of making, the expressed polypeptide or BPXTEN fusion polypeptide is recovered in which at least or at least 90%, or at least 95%, or at least 97%, or at least 99% of the polypeptide or BPXTEN fusion polypeptide is recovered in monomeric, soluble form.

In some embodiments, the disclosure relates to methods of making the polypeptide and BPXTEN fusion polypeptide at high fermentation expression levels of functional protein using an E. co/i or mammalian host cell, as well as providing expression vectors encoding the constructs useful in methods to produce the cytotoxically active polypeptide construct compositions at high expression levels. In one embodiment, the method comprises the steps of 1) preparing the polynucleotide encoding the polypeptides of any of the embodiments disclosed herein, 2) cloning the polynucleotide into an expression vector, which can be a plasmid or other vector under control of appropriate transcription and translation sequences for high level protein expression in a biological system, 3) transforming an appropriate host cell with the expression vector, and 4) culturing the host cell in conventional nutrient media under conditions suitable for the expression of the polypeptide composition. Where desired, the host cell is *E. coli*. By the method, the expression of the polypeptide results in fermentation titers of at least 0.05 g/L, or at least 0.1 g/L, or at least 0.2 g/L, or at least 0.3 g/L, or at least 0.5 g/L, or at least 0.6 g/L, or at least 0.7 g/L, or at least 0.8 g/L, or at least 0.9 g/L, or at least 1 g/L, or at least 2 g/L, or at least 3 g/L, or at least 4 g/L, or at least 5 g/L of the expression product of the host cell and wherein at least 70%, or at least 80%, or at least 90%, or at least 95%, or at least 97%, or at least 99% of the expressed protein are correctly folded. As used herein, the term "correctly folded" means that the antigen binding fragments component of the composition have the ability to specifically bind its target ligand. In some embodiments, the disclosure provides a method for producing a polypeptide or BPXTEN fusion polypeptide, the method comprising culturing in a fermentation reaction a host cell that comprises a vector encoding a polypeptide comprising the polypeptide or BPXTEN fusion polypeptide under conditions effective to express the polypeptide product at a concentration of more than about 10 milligrams/gram of dry weight host cell (mg/g), or at least about 250 mg/g, or about 300 mg/g, or about 350 mg/g, or about 400 mg/g, or about 450 mg/g, or about 500 mg/g of the polypeptide when the fermentation reaction reaches an optical density of at least 130 at a wavelength of 600 nm, and wherein the antigen binding fragments of the expressed protein are correctly folded. In some embodiments, the disclosure provides a method for producing a polypeptide or BPXTEN fusion polypeptide, the method comprising culturing in a fermentation reaction a host cell that comprises a vector encoding the composition under conditions effective to express the polypeptide product at a concentration of more than about 10 milligrams/gram of dry weight host cell (mg/g), or at least about 250 mg/g, or about 300 mg/g, or about 350 mg/g, or about 400 mg/g, or about 450 mg/g, or about 500 mg/g of the polypeptide when the fermentation reaction reaches an optical density of at least 130 at a wavelength of 600 nm, and wherein the expressed polypeptide product is soluble.

Pharmaceutical Composition

Disclosed herein includes a pharmaceutical composition comprising a (fusion) polypeptide, such as any described hereinabove or described anywhere else herein, and one or more pharmaceutically acceptable excipients. In some embodiments, the pharmaceutical composition is formulated for intradermal, subcutaneous, oral, intravenous, intra-arterial, intraabdominal, intraperitoneal, intravitreal, intrathecal, or intramuscular administration. In some embodiments, the pharmaceutical composition is in a liquid form or frozen. In some embodiments, the pharmaceutical composition is in a device that is implanted into the eye or another body part. In some embodiments, the pharmaceutical composition is in a pre-filled syringe for a single injection. In some embodiments, the pharmaceutical composition is formulated as a lyophilized powder to be reconstituted prior to administration.

In some embodiments, the dose is administered intradermally, subcutaneously, orally, intravenously, intravitreally (or otherwise injected into the eye), intra-arterially, intraabdominally, intraperitoneally, intrathecally, or intramuscularly. In some embodiments, the pharmaceutical composition is administered using a device implanted into the eye or other body part. In some embodiments, the subject is a mouse, rat, monkey, or human.

The pharmaceutical compositions can be administered for therapy by any suitable route. In addition, the pharmaceutical compositions can also contain other pharmaceutically active compounds or a plurality of compounds of the invention.

In some embodiments, the pharmaceutical composition can be administered subcutaneously, orally, intramuscularly, or intravenously. In one embodiment, the pharmaceutical composition is administered at a therapeutically effective dose. In some cases of the foregoing, the therapeutically effective dose results in a gain in time spent within a therapeutic window for the fusion protein compared to the corresponding BP of the fusion protein not linked to the XTEN and administered at a comparable dose to a subject. The gain in time spent within the therapeutic window can at least threefold greater than the corresponding BP not linked to the XTEN, or alternatively, at least four-fold, or five-fold, or six-fold, or seven-fold, or eight-fold, or nine-fold, or at least 10-fold, or at least 20-fold greater than the corresponding BP not linked to the XTEN.

In some embodiments, invention provides a method of treating a disease, disorder or condition, comprising administering the pharmaceutical composition described above to a subject using multiple consecutive doses of the pharmaceutical composition administered using a therapeutically effective dose regimen. In one embodiment of the foregoing, the therapeutically effective dose regimen can result in a gain in time of at least three-fold, or alternatively, at least four-fold, or five-fold, or six-fold, or sevenfold, or eight-fold, or nine-fold, or at least 10-fold, or at least 20-fold between at least two consecutive $C_{max}$ peaks and/or $C_{mm}$ troughs for blood levels of the fusion protein compared to the corresponding BP of the fusion protein not linked to XTEN(s) and administered at a comparable dose regimen to a subject. In some embodiments of the foregoing, the administration of the fusion protein results in a comparable improvement in at least one measured parameter using less frequent dosing or a lower total dosage in moles of the fusion protein of the pharmaceutical composition compared to the corresponding biologically active protein component(s) not linked to XTEN(s) and administered to a subject using a therapeutically effective regimen to a subject.

In one embodiment, the pharmaceutical composition is administered subcutaneously. In this embodiment, the composition may be supplied as a lyophilized powder to be reconstituted prior to administration. The composition may also be supplied in a liquid form or frozen, which can be administered directly to a patient. In one embodiment, the composition is supplied as a liquid in a pre-filled syringe such that a patient can easily self-administer the composition.

Extended release formulations useful in the present invention may be oral formulations comprising a matrix and a coating composition. Suitable matrix materials may include waxes (e.g., carnauba, bees wax, paraffin wax, ceresine, shellac wax, fatty acids, and fatty alcohols), oils, hardened oils or fats (e.g., hardened rapeseed oil, castor oil, beef tallow, palm oil, and soya bean oil), and polymers (e.g., hydroxypropyl cellulose, polyvinylpyrrolidone, hydroxypropyl methyl cellulose, and polyethylene glycol). Other suitable matrix tableting materials are microcrystalline cellulose, powdered cellulose, hydroxypropyl cellulose, ethyl cellulose, with other carriers, and fillers. Tablets may also contain granulates, coated powders, or pellets. Tablets may also be multi-layered. Multi-layered tablets are especially preferred when the active ingredients have markedly different pharmacokinetic profiles. Optionally, the finished tablet may be coated or uncoated.

The coating composition may comprise an insoluble matrix polymer and/or a water-soluble material. Water soluble materials can be polymers such as polyethylene glycol, hydroxypropyl cellulose, hydroxypropyl methyl cellulose, polyvinylpyrrolidone, polyvinyl alcohol, or monomeric materials such as sugars (e.g., lactose, sucrose, fructose, mannitol and the like), salts (e.g., sodium chloride, potassium chloride and the like), organic acids (e.g., fumaric acid, succinic acid, lactic acid, and tartaric acid), and mixtures thereof. Optionally, an enteric polymer may be incorporated into the coating composition. Suitable enteric polymers include hydroxypropyl methyl cellulose, acetate succinate, hydroxypropyl methyl cellulose, phthalate, polyvinyl acetate phthalate, cellulose acetate phthalate, cellulose acetate trimellitate, shellac, zein, and polymethacrylates containing carboxyl groups. The coating composition may be plasticised by adding suitable plasticisers such as, for example, diethyl phthalate, citrate esters, polyethylene glycol, glycerol, acetylated glycerides, acetylated citrate esters, dibutylsebacate, and castor oil. The coating composition may also include a filler, which can be an insoluble material such as silicon dioxide, titanium dioxide, talc, kaolin, alumina, starch, powdered cellulose, MCC, or polacrilin potassium. The coating composition may be applied as a solution or latex in organic solvents or aqueous solvents or mixtures thereof. Solvents such as water, lower alcohol, lower chlorinated hydrocarbons, ketones, or mixtures thereof may be used.

BPXTEN polypeptides of the present invention can be formulated according to known methods to prepare pharmaceutically useful compositions, whereby the polypeptide is combined in admixture with a pharmaceutically acceptable carrier vehicle, such as aqueous solutions or buffers, pharmaceutically acceptable suspensions and emulsions. Examples of non-aqueous solvents include propyl ethylene glycol, polyethylene glycol and vegetable oils. Therapeutic formulations are prepared for storage by mixing the active ingredient having the desired degree of purity with optional physiologically acceptable carriers, excipients or stabilizers, as described in Remington's Pharmaceutical Sciences 16th edition, Osol, A. Ed. (1980), in the form of lyophilized formulations or aqueous solutions. The compositions of the invention may be formulated using a variety of excipients. Suitable excipients include microcrystalline cellulose (e.g. Avicel PH 102, Avicel PHl01), polymethacrylate, poly(ethyl acrylate, methyl methacrylate, trimethylammonioethyl methacrylate chloride) (such as Eudragit RS-30D), hydroxypropyl methylcellulose (Methocel KlOOM, Premium CR Methocel KlOOM, Methocel E5, Opadry®), magnesium stearate, talc, triethyl citrate, aqueous ethylcellulose dispersion (Surelease®), and protamine sulfate. The slow release agent may also comprise a carrier, which can comprise, for example, solvents, dispersion media, coatings, antibacterial and antifungal agents, isotonic and absorption delaying agents. Pharmaceutically acceptable salts can also be used in these slow release agents, for example, mineral salts such as hydrochlorides, hydrobromides, phosphates, or sulfates, as well as the salts of organic acids such as acetates, proprionates, malonates, or benzoates. The composition may also contain liquids, such as water, saline, glycerol, and ethanol, as well as substances such as wetting agents, emulsifying agents, or pH buffering agents. Liposomes may also be used as a carrier.

In some embodiments, the compositions of the present invention are encapsulated in liposomes, which have demonstrated utility in delivering beneficial active agents in a controlled manner over prolonged periods of time. Liposomes are closed bilayer membranes containing an entrapped aqueous volume. Liposomes may also be unilamellar vesicles possessing a single membrane bilayer or multilamellar vesicles with multiple membrane bilayers, each separated from the next by an aqueous layer. The structure of the resulting membrane bilayer is such that the hydrophobic (non-polar) tails of the lipid are oriented toward the center of the bilayer while the hydrophilic (polar) heads orient towards the aqueous phase. In one embodiment, the liposome may be coated with a flexible water-soluble polymer that avoids uptake by the organs of the mononuclear phagocyte system, primarily the liver and spleen. Suitable hydrophilic polymers for surrounding the liposomes include, without limitation, PEG, polyvinylpyrrolidone, polyvinylmethylether, polymethyloxazoline, polyethyloxazoline, polyhydroxypropyloxazoline, polyhydroxypropylmethacrylamide, polymethacrylamide, polydimethylacrylamide, polyhydroxypropylmethacrylate, polyhydroxethylacrylate, hydroxymethylcellulose hydroxyethylcellulose, polyethyleneglycol, polyaspartamide and hydrophilic peptide sequences as described in U.S. Pat. Nos. 6,316,024; 6,126,966; 6,056,973; 6,043,094, the contents of which are incorporated by reference in their entirety.

Liposomes may be comprised of any lipid or lipid combination known in the art. For example, the vesicle-forming lipids may be naturally-occurring or synthetic lipids, including phospholipids, such as phosphatidylcholine, phosphatidylethanolamine, phosphatidic acid, phosphatidylserine, phosphatidylglycerol, phosphatidylinositol, and sphingomyelin as disclosed in U.S. Pat. Nos. 6,056,973 and 5,874,104. The vesicle-forming lipids may also be glycolipids, cerebrosides, or cationic lipids, such as 1,2-dioleyloxy-3-(trimethylamino) propane (DOTAP); N-[1-(2,3,-ditetradecyloxy)propyl]-N,N-dimethyl-N-hydroxyethylammonium bromide (DMRIE); N-[I [(2,3,-dioleyloxy)propyl]-N,N-dimethyl-N-hydroxy ethylammonium bromide (DORIE); N-[I-(2,3-dioleyloxy)propyl]-N,N,N-trimethylammonium chloride (DOTMA); 3 [N—(N',N'-dimethylaminoethane) carbamoyl] cholesterol (DC-Choi); or dimethyldioctadecylammonium (DDAB) also as disclosed in U.S. Pat. No. 6,056,973. Cholesterol may also be present in the proper range to impart stability to the vesicle as disclosed in U.S. Pat. Nos. 5,916,588 and 5,874,104.

Additional liposomal technologies are described in U.S. Pat. Nos. 6,759,057; 6,406,713; 6,352,716; 6,316,024; 6,294,191; 6,126,966; 6,056,973; 6,043,094; 5,965,156; 5,916,588; 5,874,104; 5,215,680; and 4,684,479, the contents of which are incorporated herein by reference. These describe liposomes and lipid-coated microbubbles, and methods for their manufacture. Thus, one skilled in the art, considering both the disclosure of this invention and the disclosures of these other patents could produce a liposome for the extended release of the polypeptides of the present invention. For liquid formulations, a desired property is that the formulation be supplied in a form that can pass through a 25-, 28-, 30-, 31-, 32-gauge needle for intravenous, intramuscular, intraarticular, or subcutaneous administration.

Administration via transdermal formulations can be performed using methods also known in the art, including those described generally in, e.g., U.S. Pat. Nos. 5,186,938 and 6,183,770, 4,861,800, 6,743,211, 6,945,952, 4,284,444, and WO 89/09051, incorporated herein by reference in their entireties. A transdermal patch is a particularly useful embodiment with polypeptides having absorption problems. Patches can be made to control the release of skin-permeable active ingredients over a 12 hour, 24 hour, 3 day, and 7 day period. In one example, a 2-fold daily excess of a polypeptide of the present invention is placed in a non-volatile fluid. The compositions of the invention are provided in the form of a viscous, non-volatile liquid. The penetration through skin of specific formulations may be measures by standard methods in the art (for example, Franz et al., J. Invest. Derm. 64: 194-195 (1975)). Examples of suitable patches are passive transfer skin patches, iontophoretic skin patches, or patches with microneedles such as Nicoderm. In other embodiments, the composition may be delivered via intranasal, buccal, or sublingual routes to the brain to enable transfer of the active agents through the olfactory passages into the CNS and reducing the systemic administration. Devices commonly used for this route of administration are included in U.S. Pat. No. 6,715,485. Compositions delivered via this route may enable increased CNS dosing or reduced total body burden reducing systemic toxicity risks associated with certain drugs. Preparation of a pharmaceutical composition for delivery in a subdermally implantable device can be performed using methods known in the art, such as those described in, e.g., U.S. Pat. Nos. 3,992,518; 5,660,848; and 5,756,115.

Osmotic pumps may be used as slow release agents in the form of tablets, pills, capsules or implantable devices. Osmotic pumps are well known in the art and readily available to one of ordinary skill in the art from companies experienced in providing osmotic pumps for extended release drug delivery. Examples are ALZA's DUROS™; ALZA's OROS™; Osmotica Pharmaceutical's Osmodex™ system; Shire Laboratories' EnSoTrol™ system; and Alzet™. Patents that describe osmotic pump technology are U.S. Pat. Nos. 6,890,918; 6,838,093; 6,814,979; 6,713,086; 6,534,090; 6,514,532; 6,361,796; 6,352,721; 6,294,201; 6,284,276; 6,110,498; 5,573,776; 4,200,0984; and 4,088,864, the contents of which are incorporated herein by reference. One skilled in the art, considering both the disclosure of this invention and the disclosures of these other patents could produce an osmotic pump for the extended release of the polypeptides of the present invention.

Syringe pumps may also be used as slow release agents. Such devices are described in U.S. Pat. Nos. 4,976,696; 4,933,185; 5,017,378; 6,309,370; 6,254,573; 4,435,173; 4,398,908; 6,572,585; 5,298,022; 5,176,502; 5,492,534; 5,318,540; and 4,988,337, the contents of which are incorporated herein by reference. One skilled in the art, considering both the disclosure of this invention and the disclosures of these other patents could produce a syringe pump for the extended release of the compositions of the present invention.

Pharmaceutical Kits

In some embodiments, the invention provides a kit to facilitate the use of the BPXTEN polypeptides. In one embodiment, the kit comprises, in at least a first container: (a) an amount of a BPXTEN fusion protein composition sufficient to treat a disease, condition or disorder upon administration to a subject in need thereof, and (b) an amount of a pharmaceutically acceptable carrier; together in a formulation ready for injection or for reconstitution with sterile water, buffer, or dextrose; together with a label identifying the BPXTEN drug and storage and handling conditions, and a sheet of the approved indications for the drug, instructions for the reconstitution and/or administration of the BPXTEN drug for the use for the prevention and/or treatment of an approved indication, appropriate dosage and safety information, and information identifying the lot and expiration of the drug. In some embodiments of the foregoing, the kit can comprise a second container that can carry a suitable diluent for the BPXTEN composition, which will provide the user with the appropriate concentration of BPXTEN to be delivered to the subject.

Method of Treatment

Disclosed herein includes use of a polypeptide, such as any described hereinabove or described anywhere else herein, in the preparation of a medicament for the treatment of a disease in a subject. In some embodiments, the particular disease to be treated will depend on the choice of the biologically active proteins. In some embodiments, the disease is cancer (including any form thereof) In some cases, the cancer or tumor can be characterized by a low, medium, or high level of HER2 expression.

Disclosed herein includes a method of treating a disease in a subject, the method comprising administering to the subject in need thereof one or more therapeutically effective doses of the pharmaceutical composition, such as any described hereinabove or described anywhere else herein. In some embodiments, the disease is cancer (including any form thereof) In some embodiments, the subject is a mouse, rat, monkey, and human. In some cases, the cancer or tumor can be characterized by a low, medium, or high level of HER2 expression.

In certain embodiments, the HER-2 targeted bispecific compositions of the present invention (and particularly AMX818) may be advantageously combined with a second therapeutic agent effective for treating or ameliorating the effects of the cancer. The additional therapeutic agent may be selected from the group consisting of an antibody, an antibody fragment, an antibody conjugate, a cytotoxic agent, a toxin, a radionuclide, an immunomodulator, a photoactive therapeutic agent, a radiosensitizing agent, a hormone, an anti-angiogenesis agent, and combinations thereof. Particularly preferred second or additional therapeutic agents include other HER2 targeting agents, chemotherapy agents, radiotherapeutic agents, as well as agents that target HER3 and other targets that are involved in resistance to treatment of HER2-driven cancers.

Examples of therapeutic antibodies that may be used in the present invention include rituximab (Rituxan), Brentuximab Vedotin (Adcetriz), Ado-trastuzumab emtansine (Kadcyla), Cetuximab (Erbitux), bevacizumab (Avastin), Ibritumomab (Zevalin), vedolizumab (Entyvio), Ipilimumab (Yervoy), Nivolumab (Opdivo), pembrolizumab (Keytruda), Alemtuzamab atezolizumab (Tecentriq), avelumab (Bavencio), durvalumab (Imfinzi), B-701, Ofatumumab, Obinutuzumab (Gazyva) Panitumumab, plozalizumab, BI-754091, OREG-103, COM-701, BI-754111, and combinations thereof.

According to some embodiments, the antibody, fragment thereof, or conjugate thereof is selected from the group consisting of rituximab (Rituxan), Brentuximab Vedotin (Adcetriz), Ado-trastuzumab emtansine (Kadcyla), Ipilimumab (Yervoy), Nivolumab (Opdivo), pembrolizumab (Keytruda), Alemtuzamab atezolizumab (Tecentriq), durvalumab (Imfinzi), Ofatumumab, Obinutuzumab (Gazyva) Panitumumab, and combinations thereof.

In other embodiments, the additional agent may be a DNA damaging agent, antimetabolite, anti-microtubule agent, antibiotic agent, etc. DNA damaging agents include alkylating agents, platinum-based agents, intercalating agents, and inhibitors of DNA replication. Non-limiting examples of DNA alkylating agents include cyclophosphamide, mechlorethamine, uramustine, melphalan, chlorambucil, ifosfamide, carmustine, lomustine, streptozocin, busulfan, temozolomide, pharmaceutically acceptable salts thereof, prodrugs, and combinations thereof. Non-limiting examples of platinum-based agents include cisplatin, carboplatin, oxaliplatin, nedaplatin, satraplatin, triplatin tetranitrate, pharmaceutically acceptable salts thereof, prodrugs, and combinations thereof. Non-limiting examples of intercalating agents include doxorubicin, daunorubicin, idarubicin, mitoxantrone, pharmaceutically acceptable salts thereof, prodrugs, and combinations thereof. Non-limiting examples of inhibitors of DNA replication include irinotecan, topotecan, amsacrine, etoposide, etoposide phosphate, teniposide, pharmaceutically acceptable salts thereof, prodrugs, and combinations thereof. Antimetabolites include folate antagonists such as methotrexate and premetrexed, purine antagonists such as 6-mercaptopurine, dacarbazine, and fludarabine, and pyrimidine antagonists such as 5-fluorouracil, arabinosylcytosine, capecitabine, gemcitabine, decitabine, pharmaceutically acceptable salts thereof, prodrugs, and combinations thereof. Anti-microtubule agents include without limitation vinca alkaloids, paclitaxel (Taxol®), docetaxel (Taxotere®), and ixabepilone (Ixempra®). Antibiotic agents include without limitation actinomycin, anthracyclines, valrubicin, epirubicin, bleomycin, plicamycin, mitomycin, pharmaceutically acceptable salts thereof, prodrugs, and combinations thereof.

Exemplary cytotoxic agents are know to those of skill in the art, and may, for example, be selected from the group consisting of cyclophosphamide, mechlorethamine, uramustine, melphalan, chlorambucil, ifosfamide, carmustine, lomustine, streptozocin, busulfan, temozolomide, cisplatin, carboplatin, oxaliplatin, nedaplatin, satraplatin, triplatin tetranitrate, doxorubicin, daunorubicin, idarubicin, mitoxantrone, methotrexate, pemetrexed, 6-mercaptopurine, dacarbazine, fludarabine, 5-fluorouracil, arabinosylcytosine, capecitabine, gemcitabine, decitabine, vinca alkaloids, paclitaxel (Taxol), docetaxel (Taxotere), ixabepilone (Ixempra), actinomycin, anthracyclines, valrubicin, epirubicin, bleomycin, plicamycin, mitomycin, pharmaceutically acceptable salts thereof, prodrugs, and combinations thereof.

Cytotoxic agents according to the present invention also include an inhibitor of the PI3K/Akt pathway. Non-limiting examples of an inhibitor of the PI3K/Akt pathway include A-674563 (CAS #552325-73-2), AGL 2263, AMG-319 (Amgen, Thousand Oaks, Calif), AS-041164 (5-benzo[1,3]dioxol-5-ylmethylene-thiazolidine-2,4-dione), AS-604850 (5-(2,2-Difluoro-benzo[1,3]dioxol-5-ylmethylene)-thiazolidine-2,4-dione), AS-605240 (5-quinoxilin-6-methylene-1,3-thiazolidine-2,4-dione), AT7867 (CAS #857531-00-1), benzimidazole series, Genentech (Roche Holdings Inc., South San Francisco, Calif.), BML-257 (CAS #32387-96-5), BVD-723, CAL-120 (Gilead Sciences, Foster City, Calif), CAL-129 (Gilead Sciences), CAL-130 (Gilead Sciences), CAL-253 (Gilead Sciences), CAL-263 (Gilead Sciences), CAS #612847-09-3, CAS #681281-88-9, CAS #75747-14-7, CAS #925681-41-0, CAS #98510-80-6, CCT128930 (CAS #885499-61-6), CH5132799 (CAS #1007207-67-1), CHR-4432 (Chroma Therapeutics, Ltd., Abingdon, UK), FPA 124 (CAS #902779-59-3), GS-1101 (CAL-101) (Gilead Sciences), GSK 690693 (CAS #937174-76-0), H-89 (CAS #127243-85-0), Honokiol, IC87114 (Gilead Science), IPI-145 (Intellikine Inc.), KAR-4139 (Karus Therapeutics, Chilworth, UK), KAR-4141 (Karus Therapeutics), KIN-1 (Karus Therapeutics), KT 5720 (CAS #108068-98-0), Miltefosine, MK-2206 dihydrochloride (CAS #1032350-13-2), ML-9 (CAS #105637-50-1), Naltrindole Hydrochloride, OXY-111A (NormOxys Inc., Brighton, Mass.), perifosine, PHT-427 (CAS #1191951-57-1), PI3 kinase delta inhibitor, Merck KGaA (Merck & Co., Whitehouse Station, N.J.), PI3 kinase delta inhibitors, Genentech (Roche Holdings Inc.), PI3 kinase delta inhibitors, Incozen (Incozen Therapeutics, Pvt. Ltd., Hydrabad, India), PI3 kinase delta inhibitors-2, Incozen (Incozen Therapeutics), PI3 kinase inhibitor, Roche-4 (Roche Holdings Inc.), PI3 kinase inhibitors, Roche (Roche Holdings Inc.), PI3 kinase inhibitors, Roche-5 (Roche Holdings Inc.), PI3-alpha/delta inhibitors, Pathway Therapeutics (Pathway Therapeutics Ltd., South San Francisco, Calif.), PI3-delta inhibitors, Cellzome (Cellzome AG, Heidelberg, Germany), PI3-delta inhibitors, Intellikine (Intellikine Inc., La Jolla, Calif), PI3-delta inhibitors, Pathway Therapeutics-1 (Pathway Therapeutics Ltd.), PI3-delta inhibitors, Pathway Therapeutics-2 (Pathway Therapeutics Ltd.), PI3-delta/gamma inhibitors, Cellzome (Cellzome AG), PI3-delta/gamma inhibitors, Cellzome (Cellzome AG), PI3-delta/gamma inhibitors, Intellikine (Intellikine Inc.), PI3-delta/gamma inhibitors, Intellikine (Intellikine Inc.), PI3-delta/gamma inhibitors, Pathway Therapeutics (Pathway Therapeutics Ltd.), PI3-delta/gamma inhibitors, Pathway Therapeutics (Pathway Therapeutics Ltd.), PI3-gamma inhibitor Evotec (Evotec), PI3-gamma inhibitor, Cellzome (Cellzome AG), PI3-gamma inhibitors, Pathway Therapeutics (Pathway Therapeutics Ltd.), PI3K delta/gamma inhibitors, Intellikine-1 (Intellikine Inc.), PI3K delta/gamma inhibitors, Intellikine-1 (Intellikine Inc.), pictilisib (Roche Holdings Inc.), PIK-90 (CAS #677338-12-4), SC-103980 (Pfizer, New York, N.Y.), SF-1126 (Semafore Pharmaceuticals, Indianapolis, Ind.), SH-5, SH-6, Tetrahydro Curcumin, TG100-115 (Targegen Inc., San Diego, Calif), Triciribine, X-339 (Xcovery, West Palm Beach, Fla.), XL-499 (Evotech, Hamburg, Germany), pharmaceutically acceptable salts thereof, and combinations thereof.

The additional agent in the combination therapy may be a poison or venom of plant or animal origin. An example is diphtheria toxin or portions thereof. In other examples, the additional agent may be a "radionuclide" i.e., a radioactive substance administered to the patient, e.g., intravenously or orally, after which it penetrates via the patient's normal metabolism into the target organ or tissue, where it delivers local radiation for a short time. Examples of radionuclides include, but are not limited to, I-125, At-211, Lu-177, Cu-67, I-131, Sm-153, Re-186, P-32, Re-188, In-114m, and Y-90.

The term "immunomodulator" means a substance that alters the immune response by augmenting or reducing the ability of the immune system to produce antibodies or sensitized cells that recognize and react with the antigen that initiated their production. Immunomodulators may be recombinant, synthetic, or natural preparations and include cytokines, corticosteroids, cytotoxic agents, thymosin, and immunoglobulins. Some immunomodulators are naturally present in the body, and certain of these are available in pharmacologic preparations. Examples of immunomodulators include, but are not limited to, granulocyte colony-stimulating factor (G-CSF), LAG-3, IMP-321, JCAR-014, ASLAN-002 (BMS-777607), interferons, imiquimod and cellular membrane fractions from bacteria, IL-2, IL-7, IL-12, CCL3, CCL26, CXCL7, synthetic cytosine phosphate-guanosine (CpG), immune-checkpoint inhibitors, and combinations thereof. Targeted cytokine therapy, particularly targeting to lymphotoxin and LiGHT may also be useful in combination with the compositions of the present invention.

In some combination treatments, the additional agent may be a "radiosensitizing agent" that makes tumor cells more sensitive to radiation therapy. Examples of radiosensitizing agents include misonidazole, metronidazole, tirapazamine, and trans sodium crocetinate, and combination thereof.

In still other embodiments, the additional agent is an "anti-angiogenesis" agent that reduces or inhibits the growth of new blood vessels, such as, e.g., an inhibitor of vascular endothelial growth factor (VEGF) and an inhibitor of endothelial cell migration. Anti-angiogenesis agents include without limitation 2-methoxyestradiol, angiostatin, bevacizumab, cartilage-derived angiogenesis inhibitory factor, endostatin, IFN-α, IL-12, itraconazole, linomide, platelet factor-4, prolactin, SU5416, suramin, tasquinimod, tecogalan, tetrathiomolybdate, thalidomide, thrombospondin, thrombospondin, TNP-470, ziv-aflibercept, pharmaceutically acceptable salts thereof, prodrugs, and combinations thereof.

In particularly preferred embodiments, the HER2-targeted bispecific compositions of the present invention may be combined with checkpoint inhibitors, such as anti-PD-1/ anti-PD-L1 compositions, CTLA-4, OX40 and the like. In particular embodiments of such combination therapy, the compositions of the present invention can be combined with antagonists of the cell surface receptor programmed cell death protein 1, also known as PD-1 as well as, antagonists of PD-L1.

PD-1 plays an important role in down-regulating the immune system and promoting self-tolerance by suppressing T cell inflammatory activity. Binding of the PD-1 ligands, PD-L1 and PD-L2 to the PD-1 receptor found in T cells inhibits T-cell proliferation and cytokine production. Upregulation of PD-1 ligands occurs in some tumors and signaling through this pathway can contribute to inhibition of active T-cell immune surveillance of tumors. Anti-PD-1 antibodies bind to the PD-1 receptor and block its interaction with PD-L1 and PD-L3, releasing PD-1 pathway-mediated inhibition of the immune response, including the anti-tumor immune response.

Those of skill in the art are aware of various anti-PD-1 antibodies that may be used. In some embodiments, an exemplary anti-PD-1 antibody used in combination with the compounds of the present invention is Pembrolizumab (Keytruda®). In other embodiments, the anti-PD-1 antibody used in combination with the compound described above is Nivolumab (Opdivo®). In other embodiments, the anti-PD-1 antibody used in combination with the compound described above is Pidilizumab (Medivation).

Additional PD-1 antibodies known to those of skill in the art, include AGEN-2034 (Agenus), AMP-224 (Medimmune), BCD-100 (Biocad), BGBA-317 (Beigene), BI-754091 (Boehringer Ingelheim), CBT-501 (Genor Biopharma), CC-90006 (Celgene), cemiplimab (Regeneron Pharmaceuticals), durvalumab+MEDI-0680 (Medimmune), GLS-010 (Harbin Gloria Pharmaceuticals), IBI-308 (Eli Lilly), JNJ-3283 (Johnson & Johnson), JS-001 (Shanghai Junshi Bioscience Co.), MEDI-0680 (Medimmune), MGA-012 (MacroGenics), MGD-013 (Marcogenics), pazopanib hydrochloride+pembrolizumab (Novartis), PDR-001 (Novartis), PF-06801591 (Pfizer), REGN-2810 (Regeneron), SHR-1210 (Jiangsu Hengrui Medicine Co.), TSR-042 (Tesaro Inc.), LZM-009 (Livzon Pharmaceutical Group Inc) and ABBV-181 (AbbVie Inc). Each possibility represents a separate embodiment of the present invention.

In one preferred embodiment for combination therapy of the present invention, the anti-PD-1 antibody is pembrolizumab (Keytruda®).

In other embodiments, the compositions of the present invention are combined with an anti-PD-L1 antibody. Exemplary such anti-PD-L1 antibodies used in the combinations of the present invention may be selected from the group consisting of Durvalumab (MedImmune LLC), Atezolizumab (Hoffmann-La Roche Ltd, Chugai Pharmaceutical Co Ltd), Avelumab (Merck KGaA), CX-072 (CytomX Therapeutics Inc), BMS-936559 (ViiV Healthcare Ltd), SHR-1316 (Jiangsu Hengrui Medicine Co Ltd), M-7824 (Merck KGaA), LY-3300054 (Eli Lilly and Co), FAZ-053 (Novartis AG), KN-035 (AlphaMab Co Ltd), CA-170 (Curis Inc), CK-301 (TG Therapeutics Inc), CS-1001 (CStone Pharmaceuticals Co Ltd), HLX-10 (Shanghai Henlius Biotech Co Ltd), MCLA-145 (Merus NV), MSB-2311 (MabSpace Biosciences (Suzhou) Co Ltd) and MEDI-4736 (Medimmune).

In certain other embodiments, the combination therapies of the present invention may include other HER2-direct therapies. For example, it may be advantageous to combine the compositions of the present invention with trastuzumab and related HER2 based (i.e., those that target the trastuzumab epitope) therapies such as Trastuzumab, Trastuzumab based ADCs, Kadcyla, Enhertu, HER2 tyrosine kinase inhibitors such as lapatinib, neratinib, tucatinib, HER2 targeting immunoconjugates, such as TLRs, and cytokines. Other immunotherapies and checkpoint inhibitor-based therapies that may be useful in combination with the compositions of the present invention include CTLA4, TIGIT, OX40, PD1, PDL1, TIM3-based therapies. The compositions of the invention may further be combined with CAR-T, NK, or T-cell based therapies, as well as with immunotherapy vaccines. Combination with cytokines and therapies that are cytokine targeting also are contemplated. Of particular interest may be use of TGFb, VEGF and VEGFR1-3 and anti-angiogenesis targeting therapies such as Avastin, Ramucirumab, or tyrosine kinase inhibitors such as axitinib, lenvatinib, cabozantinib, regorafenib, sunitib, sorafenib. In other embodiments, CDK4/6 inhibitors such as palbociclib and the like may be used. EGFR inhibitors such as cetuximab, panitumumab, erlotinib, and Osimertinib also may be of use in combination therapies.

The following are examples of compositions and evaluations of compositions of the disclosure. It is understood that various other embodiments may be practiced, given the general description provided above.

EXAMPLES

Example 1. Design of Barcoded XTEN by Minimal Mutations from General-Purpose XTEN This example illustrates an exemplary design approach to barcoded XTEN by making minimal mutation(s) of the amino acid sequence of a general-purpose XTEN (such as one of Table 3b hereinabove). The relevant criteria for performing minimal mutation(s) include one or more of the following: (a) to minimize the sequence change of the corresponding XTEN; (b) to minimize the amino acid composition change in the corresponding XTEN; (c) to substantially maintain the net charge in the corresponding XTEN; (d) to substantially maintain the low immunogenicity of the corresponding XTEN; (e) to substantially maintain the pharmacokinetic properties afforded by the XTEN.

For example, barcoded XTENs were constructed by performing one or more mutations comprising deletion of a glutamic acid residue, insertion of a glutamic acid residue, substitution of a glutamic acid residue, or substitution for a glutamic acid residue, or any combination thereof to the general-purpose XTENs in Table 9.

TABLE 9

Four general-purpose XTENs used for engineering of barcoded XTEN

| SEQ ID NO. | XTEN Name | Amino Acid Sequence |
|---|---|---|
| 676 | AE144 | GSEPATSGSETPGTSESATPESGPGSEPATSGSETPGSPAGSPTSTEEGTSTEPSEG SAPGSEPATSGSETPGSEPATSGSETPGSEPATSGSETPGTSTEPSEGSAPGTSESA TPESGPGSEPATSGSETPGTSTEPSEGSAP |
| 677 | AE288_1 | GTSESATPESGPGSEPATSGSETPGTSESATPESGPGSEPATSGSETPGTSESATPE SGPGTSTEPSEGSAPGSPAGSPTSTEEGTSESATPESGPGSEPATSGSETPGTSESA TPESGPGSPAGSPTSTEEGSAPGSPTSTEEGTSTEPSEGSAPGTSESATPESGPGTS ESATPESGPGTSESATPESGPGSEPATSGSETPGSEPATSGSETPGSPAGSPTSTEE GTSTEPSEGSAPGTSTEPSEGSAPGSEPATSGSETPGTSESATPESGPGTSTEPSEG SAP |
| 678 | AE576 | GSPAGSPTSTEEGTSESATPESGPGTSTEPSEGSAPGSPAGSPTSTEEGTSTEPSEG SAPGTSTEPSEGSAPGTSESATPESGPGSEPATSGSETPGSEPATSGSETPGSPAGS PTSTEEGTSESATPESGPGTSTEPSEGSAPGTSTEPSEGSAPGSPAGSPTSTEEGTS TEPSEGSAPGTSTEPSEGSAPGTSESATPESGPGTSTEPSEGSAPGTSESATPESGP GSEPATSGSETPGTSTEPSEGSAPGTSTEPSEGSAPGTSESATPESGPGTSESATPE SGPGSPAGSPTSTEEGTSESATPESGPGSEPATSGSETPGTSESATPESGPGTSTEP SEGSAPGTSTEPSEGSAPGTSTEPSEGSAPGTSTEPSEGSAPGTSTEPSEGSAPGTS TEPSEGSAPGSPAGSPTSTEEGTSTEPSEGSAPGTSESATPESGPGSEPATSGSETP GTSESATPESGPGSEPATSGSETPGTSESATPESGPGTSTEPSEGSAPGTSESATPE SGPGSPAGSPTSTEEGSPAGSPTSTEEGSPAGSPTSTEEGTSESATPESGPGTSTEP SEGSAP |
| 679 | AE864 | GSPAGSPTSTEEGTSESATPESGPGTSTEPSEGSAPGSPAGSPTSTEEGTSTEPSEG SAPGTSTEPSEGSAPGTSESATPESGPGSEPATSGSETPGSEPATSGSETPGSPAGS PTSTEEGTSESATPESGPGTSTEPSEGSAPGTSTEPSEGSAPGSPAGSPTSTEEGTS TEPSEGSAPGTSTEPSEGSAPGTSESATPESGPGTSTEPSEGSAPGTSESATPESGP GSEPATSGSETPGTSTEPSEGSAPGTSTEPSEGSAPGTSESATPESGPGTSESATPE SGPGSPAGSPTSTEEGTSESATPESGPGSEPATSGSETPGTSESATPESGPGTSTEP SEGSAPGTSTEPSEGSAPGTSTEPSEGSAPGTSTEPSEGSAPGTSTEPSEGSAPGTS TEPSEGSAPGSPAGSPTSTEEGTSTEPSEGSAPGTSESATPESGPGSEPATSGSETP GTSESATPESGPGSEPATSGSETPGTSESATPESGPGTSTEPSEGSAPGTSESATPE SGPGSPAGSPTSTEEGSPAGSPTSTEEGSPAGSPTSTEEGTSESATPESGPGTSTEP SEGSAPGTSESATPESGPGSEPATSGSETPGTSESATPESGPGSEPATSGSETPGTS ESATPESGPGTSTEPSEGSAPGSPAGSPTSTEEGTSESATPESGPGSEPATSGSETP GTSESATPESGPGSPAGSPTSTEEGSPAGSPTSTEEGTSTEPSEGSAPGTSESATPE SGPGTSESATPESGPGTSESATPESGPGSEPATSGSETPGSEPATSGSETPGSPAGS PTSTEEGTSTEPSEGSAPGTSTEPSEGSAPGSEPATSGSETPGTSESATPESGPGTS TEPSEGSAP |

Example 2. Sequence Analysis of Barcoded XTEN and Selection Thereof for Fusion to a Biologically-Active Polypeptide ("BP")

This example illustrates the design and selection of barcoded XTEN (and the assembly of more than one barcoded XTENs into a set) for fusion to a biologically-active polypeptide. Depending on the location of the barcode fragment(s) within the XTEN(s) and the manner in which the XTEN(s) is/are fused to a biologically-active protein to form an XTEN-containing construct (e.g., an XTENylated protease-activated T-cell engager (XPAT)), the barcode fragment(s) can indicate truncation(s) of the XTEN.

In silico GluC digestion analysis was performed on two exemplary XTENs (XTEN864 and XTEN288_1) to identify the releasable peptide fragments upon complete GluC digestion of the XTEN. The in silico analysis will take into consideration that, with respect to the XTEN having consecutive glutamic acid residues (e.g., "EE"), GluC may cleave after either one of the glutamic acid residues. As shown in the results summarized below in Table 10, a 10-mer peptide sequence "TPGTSTEPSE" (SEQ ID NO: 96) and a 14-mer peptide sequence "GSAPGSEPATSGSE" (SEQ ID NO: 97) each occur once and only once in the longer XTEN864, while all other peptide sequences occur two or more times in XTEN864. And the 14-mer peptide sequence "GSAPGSEPATSGSE" (SEQ ID NO: 97) also occurs once and only once in the shorter XTEN288_1.

The uniqueness of a candidate barcode is assessed in relation to all other peptide fragments releasable from the XTEN-containing construct. Accordingly, a barcode sequence in one XTEN cannot occur anywhere else in the XTEN-containing construct, including any other XTEN contained therewithin, any biologically-active protein contained therewithin, or any connection between neighboring components thereof. For example, Table 11 shows a peptide "uniqueness" table for the set of two XTEN. Due to its presence in both XTEN864 and XTEN288, the 14-mer peptide sequence "GSAPGSEPATSGSE" (SEQ ID NO: 97) is not unique to the set of XTEN comprising both XTEN864 and XTEN288 and, thus, may not be used as a barcode for detecting truncations in polypeptide products that contain both of the two XTEN sequences.

The selection of a barcode (or a set of barcodes) may further involve identifying and determining the proper location(s) or position(s) of the candidate barcode(s) within the XTEN. The location or position of a candidate barcode can be associated with pharmacologically relevant information of the XTEN (and the XTEN-containing construct as a whole), such as truncation of the XTEN beyond a critical length and/or deletion(s) in the XTEN sequence. The 10mer peptide "TPGTSTEPSE" (SEQ ID NO: 96) could serve as a suitable barcode fragment if XTEN864 is placed at the N-terminus of the XTEN-containing product and if the truncation of 238 amino acids from the N-terminus of the product does not significantly impact the pharmacological properties of the product.

TABLE 10

Representative XTEN sequences for in silico GluC digestion analysis

| Exemplary XTEN | Amino acid sequence |
|---|---|
| XTEN864 | GSPAGSPTSTEEGTSESATPESGPGTSTEPSEGSAPGSPAGSPTSTEEGTSTEPSEGSAPGTSTE PSEGSAPGTSESATPESGPGSEPATSGSETPGSEPATSGSETPGSPAGSPTSTEEGTSESATPES GPGTSTEPSEGSAPGTSTEPSEGSAPGSPAGSPTSTEEGTSTEPSEGSAPGTSTEPSEGSAPGTS ESATPESGPGTSTEPSEGSAPGTSESATPESGPGSEPATSGSETPGTSTEPSEGSAPGTSTEPSE GSAPGTSESATPESGPGTSESATPESGPGSPAGSPTSTEEGTSESATPESGPGSEPATSGSETPG TSESATPESGPGTSTEPSEGSAPGTSTEPSEGSAPGTSTEPSEGSAPGTSTEPSEGSAPGTSTEP SEGSAPGTSTEPSEGSAPGSPAGSPTSTEEGTSTEPSEGSAPGTSESATPESGPGSEPATSGSET PGTSESATPESGPGSEPATSGSETPGTSESATPESGPGTSTEPSEGSAPGTSESATPESGPGSPA GSPTSTEEGSPAGSPTSTEEGSPAGSPTSTEEGTSESATPESGPGTSTEPSEGSAPGTSESATPE SGPGSEPATSGSETPGTSESATPESGPGSEPATSGSETPGTSESATPESGPGTSTEPSEGSAPGS PAGSPTSTEEGTSESATPESGPGSEPATSGSETPGTSESATPESGPGSPAGSPTSTEEGSPAGSP TSTEEGTSTEPSEGSAPGTSESATPESGPGTSESATPESGPGTSESATPESGPGSEPATSGSETP GSEPATSGSETPGSPAGSPTSTEEGTSTEPSEGSAPGTSTEPSEGSAPGSEPATSGSETPGTSES ATPESGPGTSTEPSEGSAP (SEQ ID NO: 98) |
| AE288_1 | GTSESATPESGPGSEPATSGSETPGTSESATPESGPGSEPATSGSETPGTSESATPESGPGTSTE PSEGSAPGSPAGSPTSTEEGTSESATPESGPGSEPATSGSETPGTSESATPESGPGSPAGSPTST EEGSPAGSPTSTEEGTSTEPSEGSAPGTSESATPESGPGTSESATPESGPGTSESATPESGPGSE PATSGSETPGSEPATSGSETPGSPAGSPTSTEEGTSTEPSEGSAPGTSTEPSEGSAPGSEPATSG SETPGTSESATPESGPGTSTEPSEGSAP (SEQ ID NO: 99) |

TABLE 11

Peptide "uniqueness" analysis

| Peptide fragments | SEQ ID NO: | XTEN AE288_1 | XTEN864 | Both |
|---|---|---|---|---|
| SATPE | 125 | 9 | 23 | 32 |
| SGPGSEPATSGSE | 126 | 4 | 9 | 13 |
| GSAPGTSTEPSE | 127 | 1 | 10 | 11 |
| TPGTSE | 128 | 4 | 7 | 11 |
| SGPGTSTEPSE | 129 | 2 | 8 | 10 |
| GSAPGTSE | 130 | 1 | 8 | 9 |
| GTSTEPSE | 131 | 2 | 5 | 7 |
| GSAPGSPAGSPTSTEE | 132 | 1 | 4 | 5 |
| GSPAGSPTSTEE | 133 | 1 | 4 | 5 |
| SGPGTSE | 134 | 2 | 3 | 5 |
| SGPGSPAGSPTSTEE | 135 | 1 | 3 | 4 |
| TPGSEPATSGSE | 136 | 1 | 2 | 3 |
| TPGSPAGSPTSTEE | 137 | 1 | 2 | 3 |
| GSAPGSEPATSGSE | 138 | 1 | 1 | 2 |
| TPGTSTEPSE | 139 |  | 1 | 1 |

All underlined sequences produce unique GluC peptides
Non-XTEN core underlined and italic
Barcode peptides are bold Exemplary barcode peptide sequences are illustrated below in Table 12. These barcode sequences should be flanked according to the structural formula (I):

AAA-Glu-Barcode Peptide-BBB, wherein "AAA" represents Gly, Ala, Ser, Thr or Pro and "BBB" represent Gly, Ala, Ser, or Thr configured to facilitate efficient release of the barcode peptide by GluC digestion. Notably, the insertion of each barcode peptide in the XTEN may result in additional unique sequences directly preceding or following the inserted barcode peptides.

TABLE 12

List of non-limiting examples of barcode peptides

| Candidate Barcode Peptide(s) | SEQ ID NO: |
|---|---|
| SPATSGSTPE | 140 |
| GSAPATSE | 141 |
| GSAPGTATE | 142 |
| GSAPGTE | 143 |
| PATSGPTE | 144 |
| SASPE | 145 |
| PATSGSTE | 146 |
| GSAPGTSAE | 147 |
| SATSGSE | 148 |
| SGPGSTPAE | 149 |

Example 3: Design and Selection of XTEN(s) in Full Sequence XTENylated Polypeptide Constructs This example illustrates the design of a full-sequence polypeptide construct, containing two XTENs, one at the N-terminus and the other at the C-terminus.

Table 13 below illustrates XTEN sequences used in a representative barcoded BPXTEN (containing barcoded XTENs at both the N- and C-termini) and a reference BPXTEN (containing general-purpose XTENs at both the N- and C-termini). In the representative barcoded BPXTEN, a barcoded XTEN (SEQ ID No. 8014) is fused at the N-terminus of the BP, and another barcoded XTEN (SEQ ID No. 8015) is fused at the C-terminus of the BP. In the reference BPXTEN, a "Ref-N" XTEN is fused at the N-terminus of the BP, and a "Ref-C" XTEN is fused at the C-terminus of the BP. The "Ref-N" XTEN is comparable in length to the barcoded XTEN SEQ ID No. 8014; and the "Ref-C" XTEN is comparable in length to the barcoded XTEN SEQ ID No. 8015. The barcoded and reference BPXTENs each contain a reference sequence in the BP component. The reference sequence is unique and differs in molecular weight from all other peptide fragments that are releasable from the corresponding BPXTEN upon complete digestion by GluC protease (e.g., according to Example 5). The uniqueness of the reference sequence is assessed in relation to all other peptide fragments releasable from the BPXTEN construct.

TABLE 13

Representative sets of N- and C-terminal XTENs used in full-length BPXTEN constructs

| SEQ ID NO. | XTEN Type | Amino Acid Sequence | Total # of AAs |
|---|---|---|---|
| 8014 (from Table 3a) | N-terminal XTEN | SPAGSPTSTESGTSESATPESGPGTSTEPSEGSAPGTSESATPESGPGSEPAT SGSETPGTSESATPESGPGSTPAESGSETPGTSESATPESGPGTSTEPSEGSA PGSPAGSPTSTEEGTSESATPESGPGSEPATSGSETPGTSESATPESGPGSPA GSPTSTEEGSPAGSPTSTEEGTSTEPSEGSAPGTSESATPESGPGTSESATPE | 292 |

TABLE 13-continued

Representative sets of N- and C-terminal XTENs used in full-length BPXTEN constructs

| SEQ ID NO. | XTEN Type | Amino Acid Sequence | Total # of AAs |
|---|---|---|---|
| | | SGPGTSESATPESGPGSEPATSGSETPGSEPATSGSETPGSPAGSPTSTEEGT STEPSEGSAPGTSTEPSEGSAPGGSAP | |
| 8015 (from Table 3a) | C-terminal XTEN | PGSPAGSPTSTEEGTSESATPESGPGSEPATSGSETPGTSESATPESGPGTST EPSEGSAPGTSTEPSEGSAPGTSTEPSEGSAPGTSTEPSEGSAPGTSTEPSEG SAPGTSTEPSEGSAPGSPAGSPTSTEEGTSTEPSEGSAPGTSESATPESGPGS EPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEE GTSESATPESGPGTSTEPSEGSAPGTSESATPESGPGSEPATSGSETPGTSES ATPESGPGSEPATSGSETPGTSESATPESGPGTSTEPSEGSAPGSPAGSPTST EEGTSESATPESGPGSEPATSGSETPGTSESATPESGPGSPAGSPTSTEEGSP AGSPTSTEEGTSTEPSEGSAPGTSESATPESGPGTSESATPESGPGTSESATP ESGPGSEPATSGSETPGSEPATSGSETPGSPAGSPTSTEEGTSTEPSEGSAPG TESTPSEGSAPGSEPATSGSETPGTSESATPESGPGTSTEPSEGSAPGEPEA | 582 |
| 8021 Ref-N | N-terminal XTEN | SPAGSPTSTEEGTSESATPESGPGTSTEPSEGSAPGTSESATPESGPGSEPAT SGSETPGTSESATPESGPGSEPATSGSETPGTSESATPESGPGTSTEPSEGSA PGSPAGSPTSTEEGTSESATPESGPGSEPATSGSETPGTSESATPESGPGSPA GSPTSTEEGSPAGSPTSTEEGTSTEPSEGSAPGTSESATPESGPGTSESATPE SGPGTSESATPESGPGSEPATSGSETPGSEPATSGSETPGSPAGSPTSTEEGT STEPSEGSAPGTSTEPSEGSAPGGSAP | 292 |
| 8022 Ref-C | C-terminal XTEN | PGSPAGSPTSTEEGTSESATPESGPGTSTEPSEGSAPGSPAGSPTSTEEGTST EPSEGSAPGTSTEPSEGSAPGTSESATPESGPGSEPATSGSETPGSEPATSGS ETPGSPAGSPTSTEEGTSESATPESGPGTSTEPSEGSAPGTSTEPSEGSAPGS PAGSPTSTEEGTSTEPSEGSAPGTSTEPSEGSAPGTSESATPESGPGTSTEPS EGSAPGTSESATPESGPGSEPATSGSETPGTSTEPSEGSAPGTSTEPSEGSAP GTSESATPESGPGTSESATPESGPGSPAGSPTSTEEGTSESATPESGPGSEPA TSGSETPGTSESATPESGPGTSTEPSEGSAPGTSTEPSEGSAPGTSTEPSEGS APGTSTEPSEGSAPGTSTEPSEGSAPGTSTEPSEGSAPGSPAGSPTSTEEGTS TEPSEGSAPGTSESATPESGPGSEPATSGSETPGTSESATPESGPGSEPATSG SETPGTSESATPESGPGTSTEPSEGSAPGTSESATPESGPGSPAGSPTSTEEG SPAGSPTSTEEGSPAGSPTSTEEGTSESATPESGPGTSTEPSEGSAPGAAEPE A | 584 |

*Barcode peptides are bold
All underlined sequences produce unique GluC peptides;

Example 4: Recombinant Construction and Production of Barcoded XTENylated Fusion Polypeptides Example 4 illustrates recombinant construction, production, and purification of an XTENylated fusion polypeptide containing a barcoded XTEN at the C-terminus and another barcoded XTEN at the N-terminus using the methods disclosed herein.

EXPRESSION: A construct encoding an XTENylated fusion polypeptide that contains an anti-CD3 sequence (e.g., set forth in Tables 6a-6e), an anti-HER2 sequence (e.g., set forth in Table 6f), a barcoded XTEN (e.g., set forth in Table 3a) at the C-terminus, and a barcoded XTEN (e.g., set forth in Table 3a) at the N-terminus is expressed in a proprietary E. coli AmE098 strain and partitioned into the periplasm via an N-terminal secretory leader sequence (MKKNIAFL-LASMFVFSIATNAYA) (SEQ ID NO: 100), which is cleaved during translocation. Fermentation cultures are grown with animal-free complex medium at 37° C. and temperature shifted to 26° C. prior to phosphate depletion. During harvest, fermentation whole broth is centrifuged to pellet the cells. At harvest, the total volume and the wet cell weight (WCW; ratio of pellet to supernatant) are recorded, and the pelleted cells are collected and frozen at −80° C.

RECOVERY: The frozen cell pellet is resuspended in Lysis Buffer (100 mM citric acid) targeting 30% wet cell weight. The resuspension is allowed to equilibrate at pH 4.4 then homogenized at 17,000±200 bar while output temperature is monitored and maintained at 15±5° C. The pH of the homogenate is confirmed to be within the specified range (pH 4.4±0.1).

CLARIFICATION: To reduce endotoxin and host cell impurities, the homogenate is allowed to undergo low-temperature (10±5° C.), acidic (pH 4.4±0.1) flocculation overnight (15-20 hours). To remove the insoluble fraction, the flocculated homogenate is centrifuged for 40 minutes at 8,000 RCF and 2-8° C., and the supernatant is retained. To remove nucleic acid, lipids, and endotoxin and to act as a filter aid, the supernatant is adjusted to 0.1% (m/m) diatomaceous earth. To keep the filter aid suspended, the supernatant is mixed via impeller and allowed to equilibrate for 30 minutes. A filter train, consisting of a depth filter followed by a 0.22 μm filter, is assembled then flushed with MQ. The supernatant is pumped through the filter train while modulating flow to maintain a pressure drop of 25±5 psig.

Purification

Protein-L Capture: To remove host cell proteins, endotoxin, and nucleic acid, Protein-L is used to capture the kappa domain present within the aHER2 scFv of the BPX-TEN molecule. The Protein-L stationary phase (Tosoh TP AF-rProtein L-650F), Protein-L mobile phase A (11.5 mM citric acid, 24.5 mM Na$_2$HPO$_4$, 125 mM NaCl, 0.005% polysorbate 80, pH 5.0), and Protein-L mobile phase B (11 mM phosphoric acid, 0.005% polysorbate 80, pH 2.0) are used herein. The column is equilibrated with Protein-L mobile phase A. The filtrate is adjusted to pH 5.5±0.2 and loaded onto the Protein-L column targeting 2-4 g/L-resin then chased with Protein-L mobile phase A until absorbance at 280 nm (A280) returns to (local) baseline. Bound material is eluted with mobile phase B and collected as a 2 CV fraction pre-spiked with 0.4 CV of 0.5 M $Na_2HPO_4$ and is analyzed by SDS-PAGE.

C-tag Intermediate Purification: To ensure C-terminal integrity, C-tag Affinity Chromatography is used to capture the C-terminal-EPEA tag. The C-tag stationary phase (Thermo C-tagXL), C-tag mobile phase A (50 mM histidine, 200 mM NaCl, 0.005% polysorbate 80, pH 6.5), and C-tag mobile phase B (20 mM Tris, 0.6 M $MgCl_2$, 0.005% polysorbate 80, pH 7.0) are used herein. The column is equilibrated with C-tag mobile phase A. The IMAC Elution is loaded onto the C-tag column targeting 2 g/L-resin and chased with C-tag mobile phase A until absorbance at 280 nm (A280) returned to (local) baseline. Bound material is eluted with a C-tag mobile phase B. The C-tag Elution is collected as a 2 CV fraction and is analyzed by SDS-PAGE.

AEX Polishing: To separate dimer and aggregate from monomeric product Anion Exchange (AEX) chromatography is utilized to capture the electronegative N- and C-terminal XTEN domains. The AEX1 stationary phase (BIA QA-80), AEX1 mobile phase A (50 mM histidine, 200 mM NaCl, 0.005% polysorbate 80, pH 6.5), and AEX1 mobile phase B (50 mM histidine, 500 mM NaCl, 0.005% polysorbate 80, pH 6.5) are used herein. The column is equilibrated with AEX mobile phase A. The C-tag elution is diluted to 10 mS/cm with MQ, loaded targeting 2 g/L-resin, and then chased with AEX mobile phase A until absorbance at 280 nm returned to (local) baseline. Bound material is eluted with a gradient from 0% B to 100% B over 60 CV. Fractions are collected in 1 CV aliquots while A280≥2 mAU above (local) baseline. Elution fractions are analyzed by SDS-PAGE and SE-HPLC, and fractions found to be ≥98% monomer are pooled (AEX Pool) for further processing.

FORMULATION: To exchange the product into formulation buffer and to bring the product to the target concentration (0.5 g/L), Ultrafiltration/Diafiltration (UF/DF) is used. Using a 10 kDa membrane with an area of 0.1 $m^2$ and a TMP target of 15 psi, the AEX pool is concentrated to 0.5 g/L, then diluted 10-fold with Formulation Buffer (50 mM histidine, 200 mM NaCl, 0.005% polysorbate 80, pH 6.5). The AEX pool is concentrated 10-fold and diluted 10-fold two more times. The recovered Formulated product is 0.22 µm filtered within a BSC, aliquoted, labeled, and stored at −80° C. as Bulk Drug Substance (BDS). The BDS is confirmed by various analytical methods to meet all Lot Release criteria. Overall quality is analyzed by SDS-PAGE, the ratio of monomer to dimer and aggregate is analyzed by SE-HPLC, and N-terminal quality and product homogeneity is analyzed by HI-HPLC. Identity is confirmed by ESI-MS.

Example 5. Release of Barcode Peptides by Protease Digest

This example illustrates the release of barcode fragment(s) and reference fragment(s) from a polypeptide mixture that contain varying lengths or truncated forms of the XTEN-containing construct using the methods disclosed herein.

A sample of XTEN-containing construct is reduced and alkylated via incubation in DTT and then iodoacetamide, sequentially. The samples are then buffer exchanged and desalted using a size-exclusion spin cartridge. Glu-C protease is added to the samples at an enzyme to substrate ratio of 1:5 and the samples are incubated at 37° C. for digestion. Samples are then moved to 4° C. to halt the proteolytic reaction and placed in autosampler vials for analysis.

Example 6. Detection and Quantification of Barcode Peptide(s) and Reference Peptide(s)

This example illustrates mass spectrometry methods used to generate quantitative measurements of individual barcode peptides. An LC-Parallel Reaction Monitoring (PRM) method is programmed into a high-resolution accurate mass (HRAM) mass spectrometer. Unlike traditional Data-Dependent Acquisition (DDA) mass spectrometry methods, PRM methods focus on a specific set of 15-30 peptides in one run, sequencing each by MS-MS once per duty cycle. As such, this method generates eXtracted Ion Chromatograms (XICs) for the unfragmented precursor ions of the intact peptide, as well as for each fragment ion of the peptide to confirm its sequence. Fragment ion XICs are often more sensitive and selectively quantitative than the precursor ion fragments. The LC-PRM method used includes the light and heavy versions of seven barcode peptides. Chromatographic peak areas of all fragment ions of these 14 peptides are measured post-acquisition and the strongest fragment ion is used for quantitative measurement. Peak area ratios of the XTEN barcode peptides to the PAT barcode peptides are then calculated for relative XTEN:PAT abundance at various points across the XTEN molecules.

Example 7. Stable Isotope Labeling to Quantify the Peptides by Mass Spectrometry (MS)

This example illustrates the stable-isotope labeling schema to enable absolute (rather than relative) quantitation of barcode peptides from XTEN-containing polypeptides. A standard Heavy labeled Amino acid quantitative schema will be employed wherein synthetic analogues of barcode peptides in which the C-terminal Glutamic Acid is replaced with the $(^{13}C)_5H_7(^{15}N)O_3$ heavy labeled analogue are procured from a specialized vendor. A calibration curve will be prepared where a known amount of XTEN barcode containing polypeptide is serially diluted into a matrix where the heavy-labeled synthetic peptide is held at a constant concentration. Accurate quantitation can be performed by calibrating chromatographic peak area heavy:light ratios from the curve against research samples containing the same spike-level of heavy labeled peptide.

Example 8. Quantification of Truncation of XTEN-Containing Polypeptide

This example illustrates the quantification of length variants or truncation variants in a mixture of XTEN-containing polypeptides.

For example, a barcode peptide "SGPGSTPAESGSE" (SEQ ID NO: 150), is positioned 76 amino acids into the representative barcoded BPXTEN sequence described in and obtained from Example 3 to indicate a severe truncation of the XTEN at the N-terminal end of the BPXTEN. Also consider a potential barcode fragment "SPAGSPT-STESGTSE" (SEQ ID NO: 151), is positioned at the N-terminus. The abundance measurement ratio of each barcode peptide relative to a unique reference peptide sequence from the biologically active protein (e.g., an scFv fragment) sequence following the procedure of Example 6 indicates the total amount of the full-length polypeptides and the variants having truncations that could affect pharmacological efficacy in the sample mixture. The abundance measurement of at least one reference fragment is used to indicate the total amount of all variants of the polypeptide in the sample mixture. Accordingly, differential abundance between the reference fragment and the barcode fragments informs the amount of truncated polypeptide variants. The LC-MS data are analyzed to determine the ratio of the amount of the barcode fragment to the reference fragment, indicating the relative amount of pharmacologically-efficacious variants in the polypeptide mixture.

A set of two (or three) barcodes are used to indicate different levels of truncation of the polypeptide. The LC-MS data are used to determine the ratio of the amount of each barcode fragment to the amount of the reference fragment, thereby quantifying the distribution of truncation variants in the polypeptide mixture.

Example 9. In Vitro Cytotoxicity of XTENylated (Masked) and De-XTENylated (Unmasked, Activated) XPATs (Protease-Activated T Cell Engager) Against Target Cells This example illustrates masking by XTENs on XTENylated Protease-Activated T-cell engagers ("XPATs") in general, and on HER2-XPATs in particular. This example illustrates the differential in cytotoxicity of XTENylated (masked) HER2-XPATs (e.g., as set forth in Table D) and the corresponding de-XTENylated (unmasked) HER2-PATs.

The cytotoxicity of an XTENylated PAT (as set forth in Table D) and the corresponding de-XTENylated PAT (protease-treated) was determined using an in vitro cytotoxicity assay which utilized the amount of ATP present in wells of lysed target cells post treatment as a proxy for measuring cell viability. HER2-expressing target cells were seeded on white, opaque bottom plates at varying densities (BT474: 20 k cells/well, and SKOV3: 10 k cells/well) and allowed to incubate at 37° C., 5% $CO_2$ overnight (18-24 hours). Prior to the end of the overnight incubation, peripheral blood mononuclear cells (PBMCs) were thawed and incubated at 37° C., 5% $CO_2$ overnight. The PBMCs were isolated from screened, healthy donors by Ficoll density gradient centrifugation from either whole blood or from lymphocyte-enriched buffy coat preparations obtained from BioIVT. 10× XTENylated and de-XTENylated PAT titrations were prepared using a 9-point, 3-fold titration (10th point is non-treatment) with a starting concentration of 2400 nM for the XTENylated PAT and 10 nM for the de-XTENylated PAT. The PBMCs were seeded in the wells at 1:1 Effector:Target ratio. 10× XTENylated and de-XTENylated PAT titrations were diluted 10-fold into the wells for starting concentrations of 240 nM and 1 nM, respectively. The plates were incubated at 37° C., 5% $CO_2$ for 48 hours. After the 48-hour incubation, the plates were washed 3× with 1×PBS, and 100 μL of 1×PBS was added to all wells. 100 μL of CellTiter-Glo® luminescent substrate solution was added to all wells, and the plates were allowed to incubate at room temperature for 1-5 minute(s). The plates were then shaken on a plate shaker at 300-500 rpm for 30-60 seconds to mix the contents of the wells and then read in a luminometer using an integration time of 100 ms. The intensity of signal produced correlates to the amount of viable cells present in the wells. The mean of the signal from all non-treatment wells was calculated and used to determine % Live cells from treatment wells ((Treatment Signal/Mean of Non-Treatment Signal)*100=% Live). The % Live was plotted by concentration, and half maximal response (EC50) values were derived with a 4-parameter logistic regression equation using GraphPad Prism software.

Figure 5A:
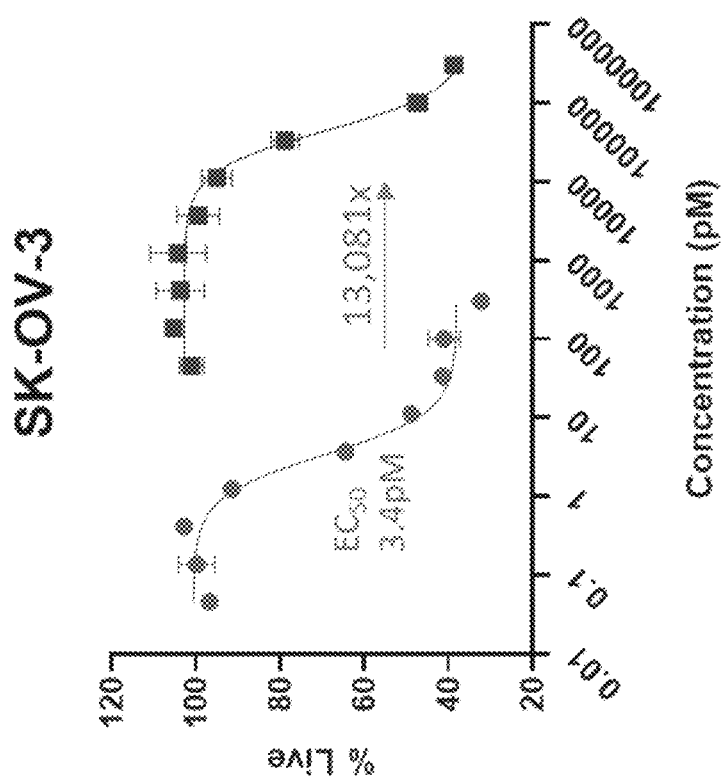
FIGS. 5A-5B and 6A-6C illustrate dose-dependent cytotoxicity of masked (XTENylated) and unmasked bispecific T-cell engagers against target cells with various levels of target antigen expression. Proteolytically-unmasked (de-XTENylated) bispecifics demonstrate potent cytotoxicity against various tumor lines, for example, with EC50s in the single-digit pM range when tested with SK-OV-3 and BT-474 cells. XTENylation further demonstrate robust masking capability, e.g., in shielding a bispecific T-cell engager from forming an immune synapse, thereby resulting in reduced toxicity as indicated by a right-ward shift in the concentration-response curve.
Figure 5B:
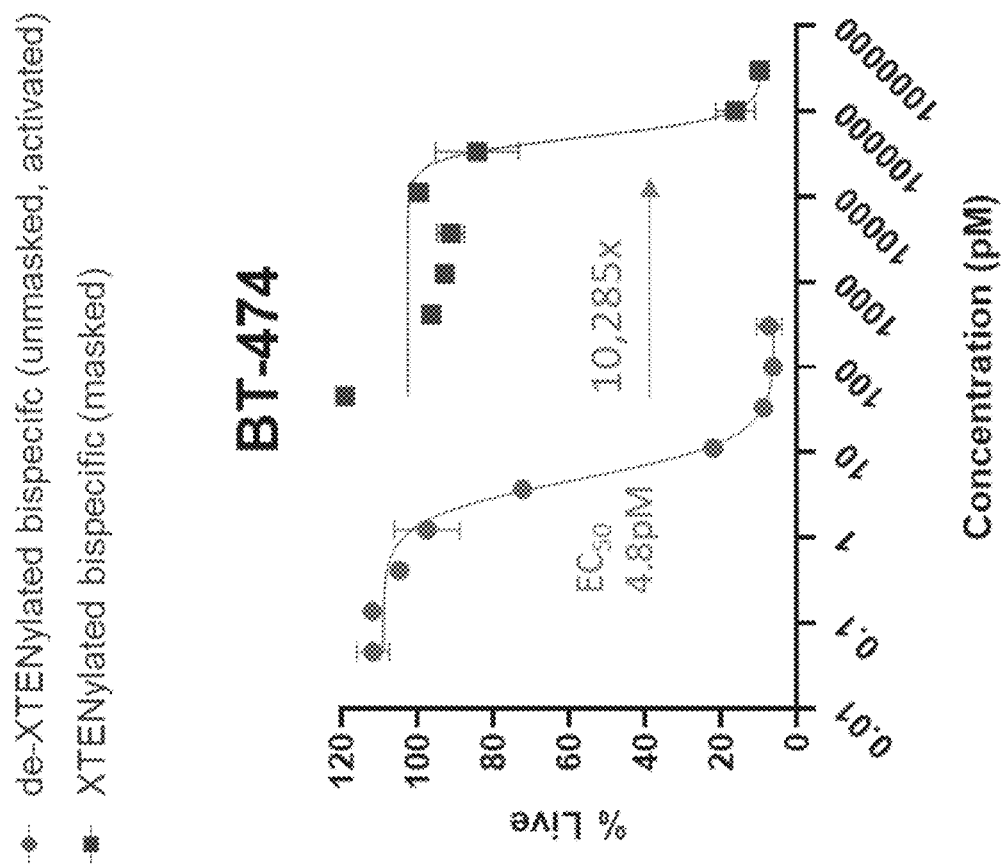

The XTENylated PAT and the corresponding de-XTENylated PAT displayed large differences in cytotoxicity on all HER2-expressing cell lines tested, confirming XTENylation results in reduction of cytolytic activity of the masked bispecific antibody (inactivated state). As shown in FIGS. 5A-5B, cytotoxicity of de-XTENylated (unmasked, activated) PAT on BT-474 and SK-OV-3 cells was observed in a dose-dependent manner, with maximal killing of ~80% observed at 0.3 nM. As shown in FIGS. 5A-5B, the de-XTENylated PAT exhibited EC50 values of 4.8 pM (BT474) and 3.4 pM (SKOV3), while the XTENylated PAT exhibited EC50 values of 49,370 pM (BT474) and 44,474 pM (SKOV3). The observations corroborate that de-XTENylated HER2-PAT has cytotoxic activity on cell lines with HER2 expression, and XTENylation masks (or shields) the ability to form an immune synapse, resulting in a reduction of cytotoxicity.

Example 10. In Vitro Cytotoxicity of XTENylated (Masked) and De-XTENylated (Unmasked, Activated) XPATs Against Target Cells that Express Low Levels of Target Antigen Example 10a Normal human cardiomyocytes express low levels of HER2 and as a result, rare cases of cardiac toxicity have been observed in patients treated with some HER2-targeted therapies. Given the known potential cardiotoxicity of HER2-targeted agents, AMX-818 toxicity against human cardiomyocytes which express HER2 was assessed. Consistent with the lack of cardiotoxicity in non-human primate (NHP) preclinical studies, AMX-818 showed limited cytotoxicity against human cardiomyocytes in vitro, even at micromolar doses. In contrast, the unmasked TCE counterpart demonstrated significantly greater cytotoxicity activity (EC50~-100 pM)

This example illustrates the sensitivity of primary cardiomyocytes to T cell-directed cytotoxicity in response to increasing concentrations of a HER2-XPAT (e.g., set forth in Table D) and its active proteolytic product, the corresponding HER2-PAT.

Normal human cardiomyocytes purchased from FujiFilm Cellular Dynamics were used. Cardiomyocytes (iCell cardiomyocytes, Cellular Dynamics International) were revived from liquid nitrogen and plated at 20,000 cells per 96-well for 7 days and treated as per the manufacturer's instructions. Human peripheral blood lymphocytes were added onto the iCell cardiomyocytes at a 1:1 Effector:Target ratio with increasing 3-fold concentrations of the XTENylated HER2-XPAT or the corresponding de-XTENylated HER2-PAT and incubated for 48 hours at 37° C., 5% $CO_2$. The assay was performed in RPMI (Roswell Park Memorial Institute) medium and 10% heat-inactivated fetal bovine serum. Cardiomyocyte cell viability was determined via ATP quantification and was performed with the Cell Titer-Glo Luminescent Cell Viability Assay System (Promega). Cell supernatant was aspirated, and cells were washed twice with phosphate buffered saline (PBS), aspirated and followed by addition of PBS (100 μl per well). Automated plate washing was carried out using an LS405 microplate washer dispenser (BioTek). Cell Titer-Glo reagent was added (100 μl per well), and assay plates were incubated for 5 minutes at room temperature. Luminescence was quantified with a multi label reader (Molecular Devices) with a luminescence detector. For analysis of cytotoxicity, % viable cells was calculated from relative luminescence units (RLU). % live=

(Test well RLU/Target cell only RLU)*100. For $EC_{50}$ determination, data were transformed in Microsoft Excel and analyzed with Graph Pad Prism 8.3.1 software 'log(agonist) vs. response-variable slope (four parameters).

Figure 6A:
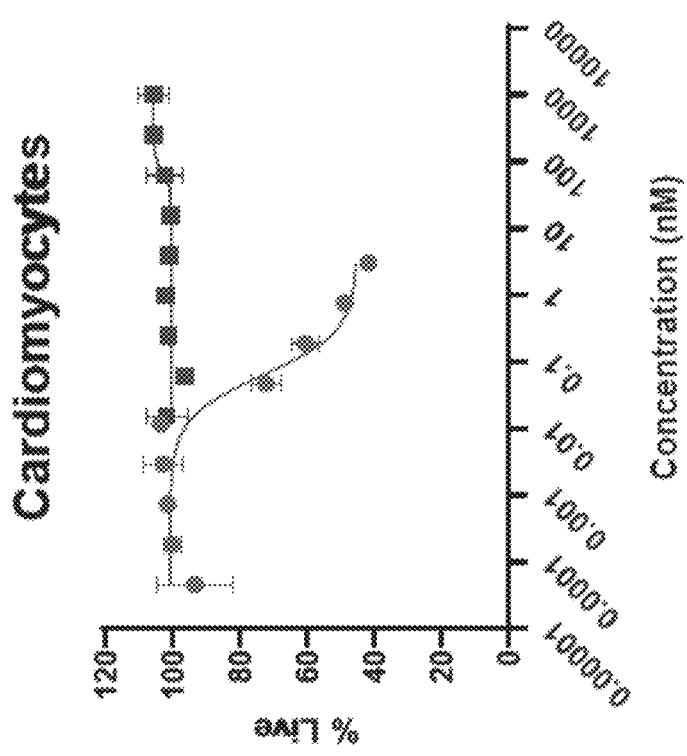

As shown in FIG. 6A, the cardiomyocytes were killed by T cell-directed cytolysis in response to the de-XTENylated HER2-PAT at approximate EC50 concentration of 64 pM, while the cardiomyocytes remained refractory to killing by XTENylated HER2-XPAT at concentrations as high as 1 pM, illustrating that the XTENylated PAT has less activity in the cardiomyocytes as compared to the cancer cell lines.

Example 10b: This example illustrates the sensitivity of another cell line with relatively low level of HER2 expression, MCF-7, to T cell-directed cytotoxicity in response to increasing concentrations of a HER2-XPAT (e.g., set forth in Table D) and its active proteolytic product, the corresponding HER2-PAT.

MCF-7 cells were cultured according to established protocols. The concentration-response curves and EC50 values were measured and analyzed according to the process outlined in Example 10a.

Figure 6B:
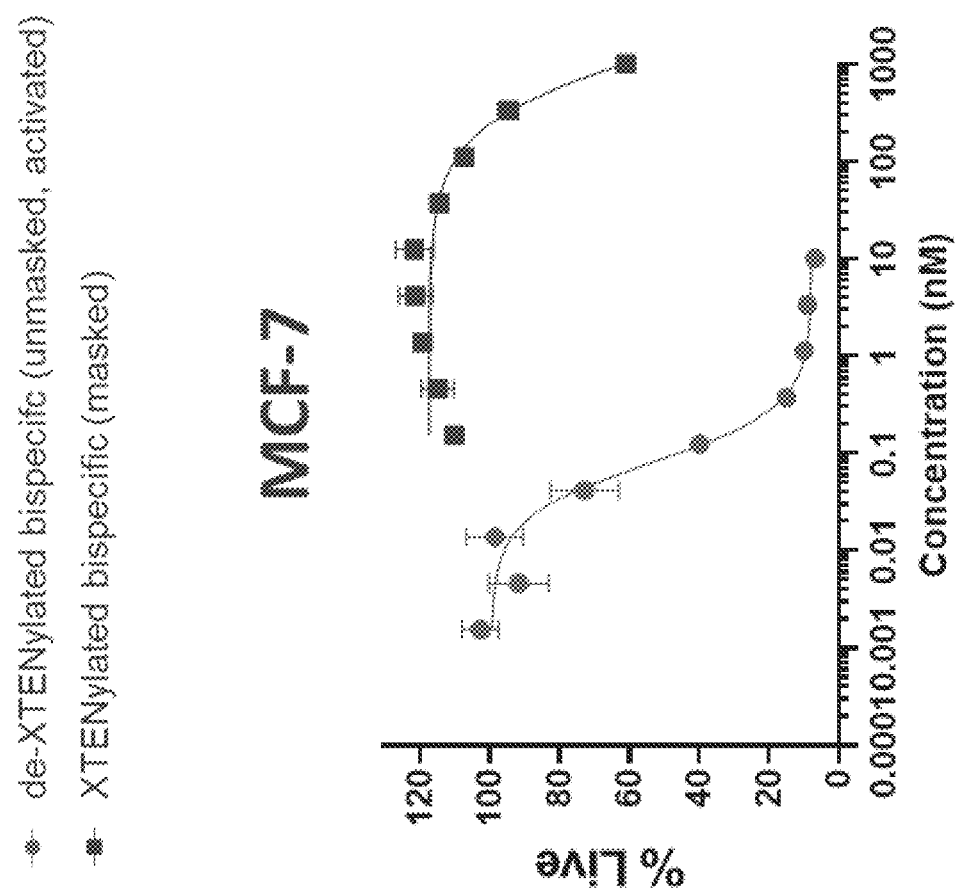

As shown in FIG. 6B, the MCF-7 cells were effectively killed by T cell-directed cytolysis in response to the proteolytically de-XTENylated HER2-XPAT (solid circles) at an EC50 concentration between 0.01 nM and 0.1 nM. XTENylation on HER2-XPAT (e.g., set forth in Table D) reduced T cell-mediated cytotoxicity by at least $10^4$-fold, as indicated by a right-ward shift of the dose-response curve (solid squares).

Example 10c

This example illustrates sensitivity of another cell line that expresses a medium level of HER2, MDA-MB-453, to T cell-directed cytotoxicity in response to increasing concentrations of a HER2-XPAT (e.g., set forth in Table D) and its active proteolytic product, the corresponding HER2-PAT. MDA-MB-453 is a breast cancer cell line with medium HER2 expression.

The cytotoxicity of an XTENylated PAT (as set forth in Table D) and the corresponding de-XTENylated PAT (protease-treated) was determined using an in vitro cytotoxicity assay which utilized the amount of ATP present in wells of lysed target cells post treatment as a proxy for measuring cell viability. HER2-expressing target cells (MDA-MB-453 line) were seeded on white, opaque bottom plates at 10 k cells/well and allowed to incubate at 37° C., 5% $CO_2$ overnight (18-24 hours). Prior to the end of the overnight incubation, peripheral blood mononuclear cells (PBMCs) were thawed and incubated at 37° C., 5% $CO_2$ for 3-4 hours. The PBMCs were isolated from screened, healthy donors by Ficoll density gradient centrifugation from either whole blood or from lymphocyte-enriched buffy coat preparations obtained from BioIVT. 10× XTENylated and de-XTENylated PAT titrations were prepared using a 7-point, 5-fold titration with a starting concentration of 3000 nM for the XTENylated PAT and 10 nM for the de-XTENylated PAT. The PBMCs were seeded in the wells at 10:1 Effector: Target ratio. 10× XTENylated and de-XTENylated PAT titrations were diluted 10-fold into the wells for starting concentrations of 300 nM and 1 nM, respectively. The plates were incubated at 37° C., 5% $CO_2$ for 48 hours. After the 48-hour incubation, the plates were washed 3× with 1×PBS, and 100 μL of 1×PBS was added to all wells. 100 μL of CellTiter-Glo® luminescent substrate solution was added to all wells, and the plates were allowed to incubate at room temperature for 1-5 minute(s). The plates were then shaken on a plate shaker at 300-500 rpm for 30-60 seconds to mix the contents of the wells and then read in a luminometer using an integration time of 100 ms. The intensity of signal produced correlates to the amount of viable cells present in the wells. The mean of the signal from all non-treatment wells was calculated and used to determine % Live cells from treatment wells ((Treatment Signal/Mean of Non-Treatment Signal)*100=% Live). The % Live was plotted by concentration, and half maximal response (EC50) values were derived with a 4-parameter logistic regression equation using GraphPad Prism software.

Figure 6C:
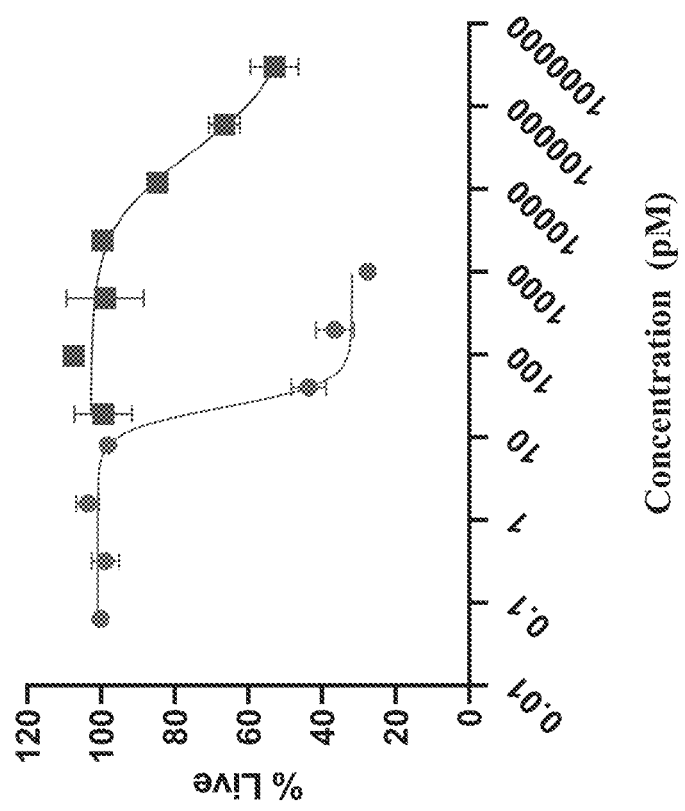

The concentration-response curves for the de-XTENylated HER2-XPAT (solid circles) and the XTENylated HER2-PAT (solid squares) are shown, respectively, in FIG. 6C.

HER2 expression levels of the cell lines tested herein are known in the art. For example, Hendriks et al. (Mol. Cancer Ther. Sep. 1, 2013; 12(9):1816-1828), which is incorporated by reference herein in its entirety, details mean HER2 level of various cells in FIG. 1E (X-axis indicates number of HER2 receptors per cell). BT-474 can have a relatively high HER2 level (an immunohistochemistry test score) of "3+"; cardiomyocytes can have a HER2 level of "2+"; and MCF-7 can have a relatively low HER2 level of "1+/0."

Example 11. Tumor Regression Induced in Subjects by Administration of XTENylated XPATs This example illustrates tumor regression induced in subjects by administration of vehicle, non-cleavable XTENylated HER2-PAT, cleavable XTENylated HER2-PAT, and unmasked HER2-PAT. The non-cleavable constructs used in the experiments are identical to the corresponding cleavable constructs, but the release site has been replaced with a non-cleavable sequence of similar length made from GASTEP amino acids (glycine, alanine, serine, threonine, glutamate, and/or proline).

Example 11a: Mice were implanted with estrogen pellets (17β-estradiol, 60 day release) at the right flank one day before the tumor inoculation. BT-474 tumor cells were inoculated subcutaneously at the right flank region of each mouse at a concentration of $2\times10^7$ BT-474/200 ul RPMI 1640 with Matrigel (1:1)/mouse for tumor development. The date of tumor cell inoculation was denoted as Day 0 (D0).

When tumors become palpable (mean tumor volume (MTV)=117 mm³) on D8, PBMCs were intravenous implanted at $1\times10^7$ PBMC/200 ul RPMI 1640/mouse. One group of mice was not injected with PBMCs (the "without hPBMCs" group) and underwent the remainder of experimental treatments in parallel with the PBMC-injected mice. When mean tumor volume reached 147 mm³ (D10), the "without hPBMCs" group of mice was administered with vehicle (diluent) (solid square in FIG. 7A); and the PBMC-injected mice were randomized into four groups and administered with vehicle (diluent) (solid circle in FIG. 7A), unmasked bispecific (solid triangle in FIG. 7A), cleavable XTENylated bispecific (hexagon in FIG. 7A), and non-cleavable XTENylated bispecific (diamond in FIG. 7A), respectively. All five groups received an equimolar dose at 15 nmol/Kg.

Figure 7A:
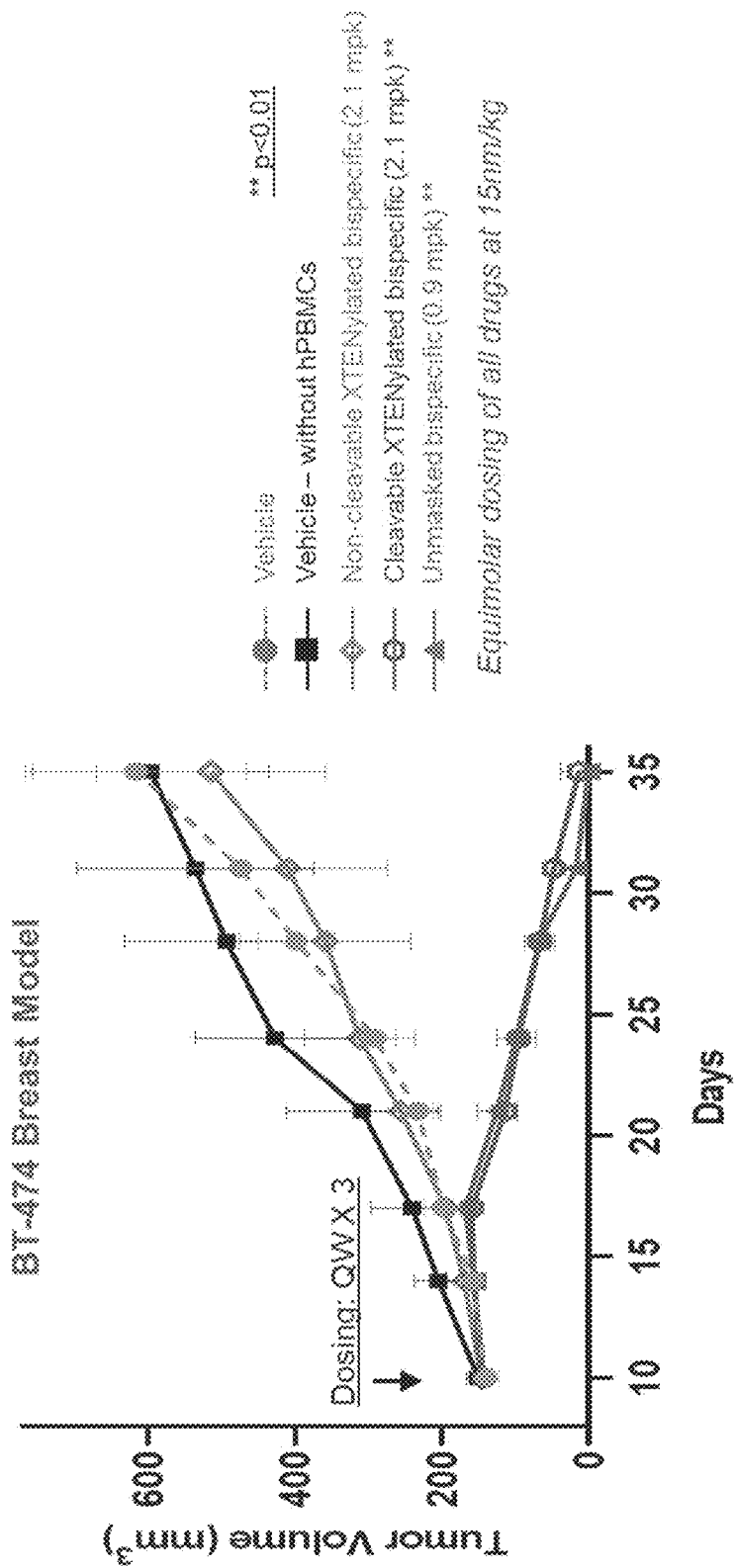
FIGS. 7A-7D illustrate proteolytic activation of XTENylated bispecifics in subjects and robust tumor regressions induced thereby.

As illustrated in FIG. 7A, by the end of study, D35, the cleavable XTENylated HER2-PAT (e.g., set forth in Table D) and the unmasked bispecific both demonstrated significant anti-tumor efficacy when compared to controls (vehicle with or without hPBMC) and the non-cleavable XTENylated bispecific counterpart. The lack of any tumor growth inhibition of the non-cleavable XTENylated bispecific construct supports that the anti-tumor efficacy observed on the XTENylated HER2 bispecific is driven by proteolytic cleavage.

Example 11b: The experimental setup implemented was similar to that described in Example 11a. Mice were implanted with estrogen pellets (17β-estradiol, 60 day release) at the right flank one day before the tumor inoculation. BT-474 tumor cells were inoculated subcutaneously at the right flank region of each mouse at a concentration of 2×10$^7$ BT-474/200 ul RPMI 1640 with Matrigel (1:1)/mouse for tumor development. The date of tumor cell inoculation was denoted as Day 0 (D0). When tumors become palpable (MTV=94 mm$^3$) on D8, PBMCs were intravenous implanted at 1×10$^7$ PBMC/200 ul RPMI 1640/mouse. One group of mice was not injected with PBMCs (the "without hPBMCs" group) and underwent the remainder of experimental treatments in parallel with the PBMC-injected mice. When MTV reached 444 mm$^3$ (D20), the PBMC injected mice were randomized, and vehicle (diluent) and test article treatments were delivered as a single dose for all groups on D21.

Figure 7B:
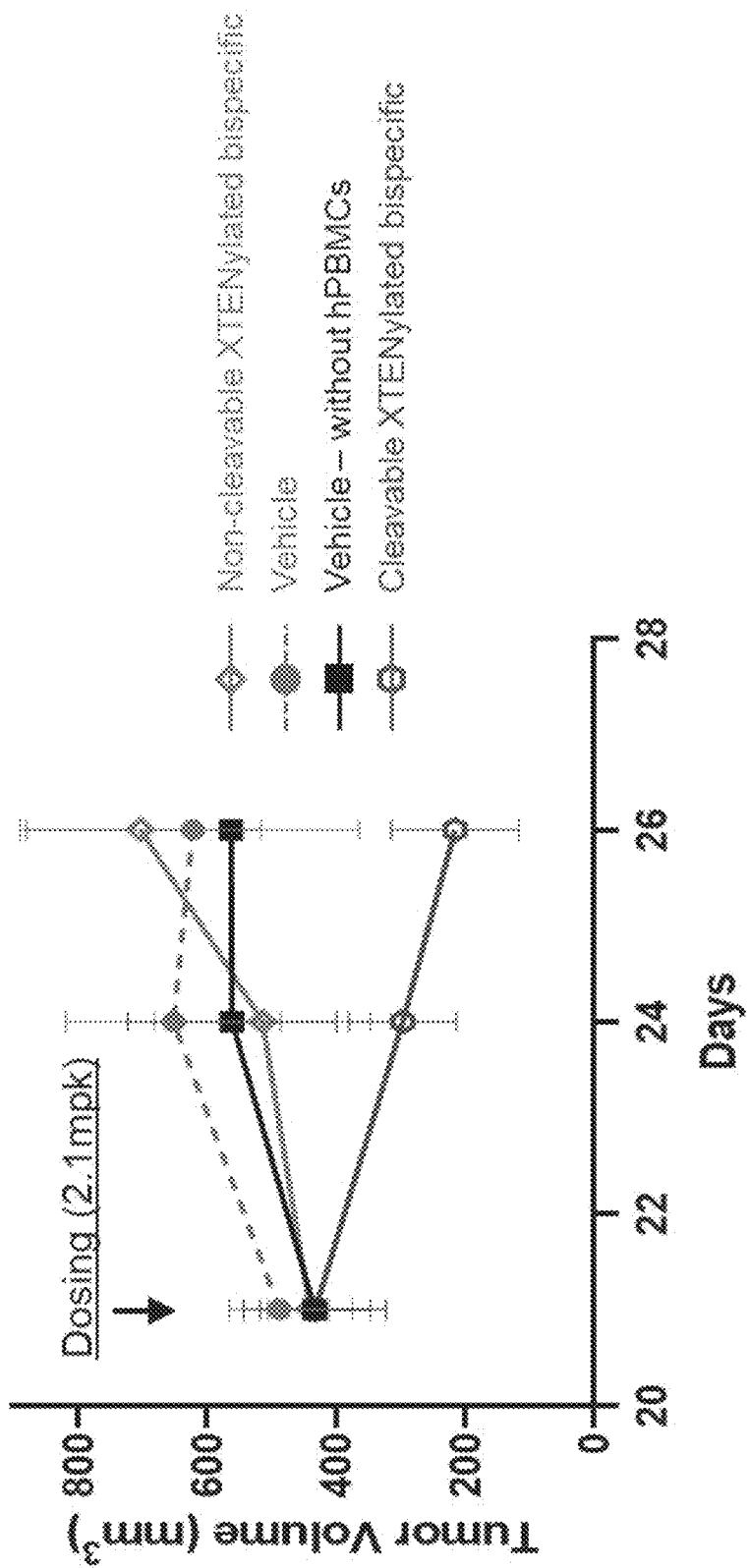

FIG. 7B illustrates significant anti-tumor efficacy of cleavable XTENylated HER2-XPAT (e.g., set forth in Table D) even in large established tumors (e.g., mean tumor volume (MTV)>400 mm$^3$) after a single dose, when compared to controls and the non-cleavable XTENylated bispecific counterpart. The lack of appreciable level of tumor growth inhibition achieved by the non-cleavable XTENylated HER2-PAT supports that the anti-tumor efficacy of the cleavable XTENylated HER2-PAT is driven by proteolytic cleavage.

Example 11c: Examples 11a and 11b used xenografts generated from a breast cancer cell line that expresses relatively high levels of HER2, in the present example, the tumor regression studies were performed using a colorectal xenograft model that is characterized by low levels of HER2 expression. Mice were inoculated subcutaneously at the right flank region of each mouse at a concentration of 5×10$^6$ HT-55/200 ul RPMI 1640 with Matrigel (1:1)/mouse for tumor development. The date of tumor cell inoculation was denoted as Day 0 (DO).

When tumors become palpable (mean tumor volume (MTV)=82 mm$^3$) on D6, PBMCs were intravenously implanted at 1×10$^7$ PBMC/200 ul RPMI 1640/mouse. One group of mice was not injected with PBMCs (the "without hPBMCs" group) and underwent the remainder of experimental treatments in parallel with the PBMC-injected mice. When mean tumor volume reached 130 mm$^3$ (D10), the "without hPBMCs" group of mice was administered with vehicle (diluent) (solid square in FIG. 7C); and the PBMC-injected mice were randomized into five groups and administered with vehicle (diluent) (solid circle in FIG. 7C), unmasked bispecific at 15 nmol/Kg (solid triangle in FIG. 7C), cleavable XTENylated bispecific at 15 nmol/Kg (triangle in FIG. 7C) cleavable XTENylated bispecific at 36 nmol/Kg (hexagon in FIG. 7C), and non-cleavable XTENylated bispecific. (diamond in FIG. 7A)

Figure 7C:
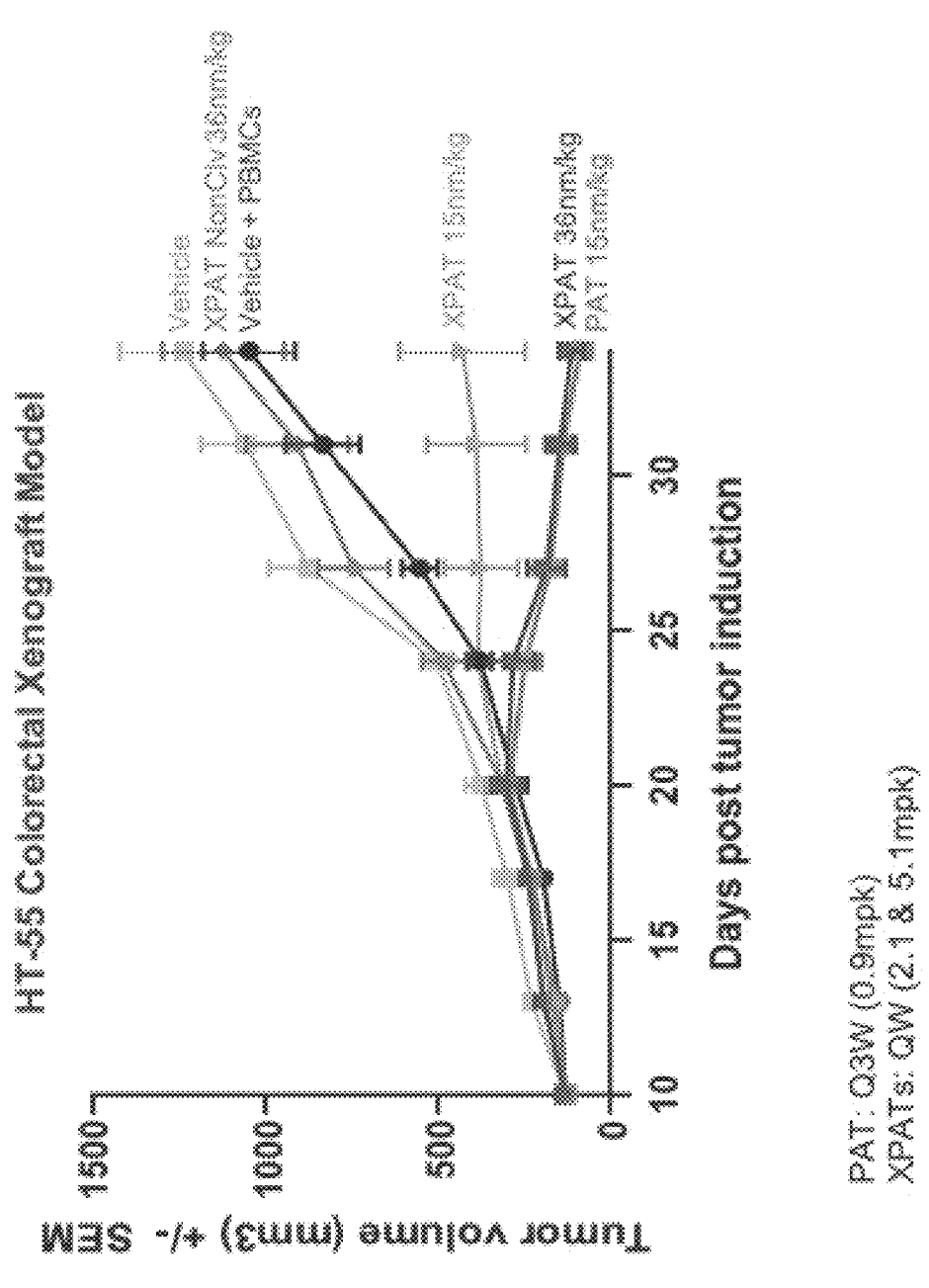

As illustrated in FIG. 7C, by the end of the study the cleavable XTENylated HER2-PAT (e.g., set forth in Table D) and the unmasked bispecific (at both 15 nmol/Kg and 36 nmol/Kg) demonstrated significant anti-tumor efficacy when compared to controls (vehicle with or without hPBMC) and the non-cleavable XTENylated bispecific counterpart. The lack of any tumor growth inhibition of the non-cleavable XTENylated bispecific construct supports that the anti-tumor efficacy observed on the XTENylated HER2 bispecific is driven by proteolytic cleavage.

Figure 7D:
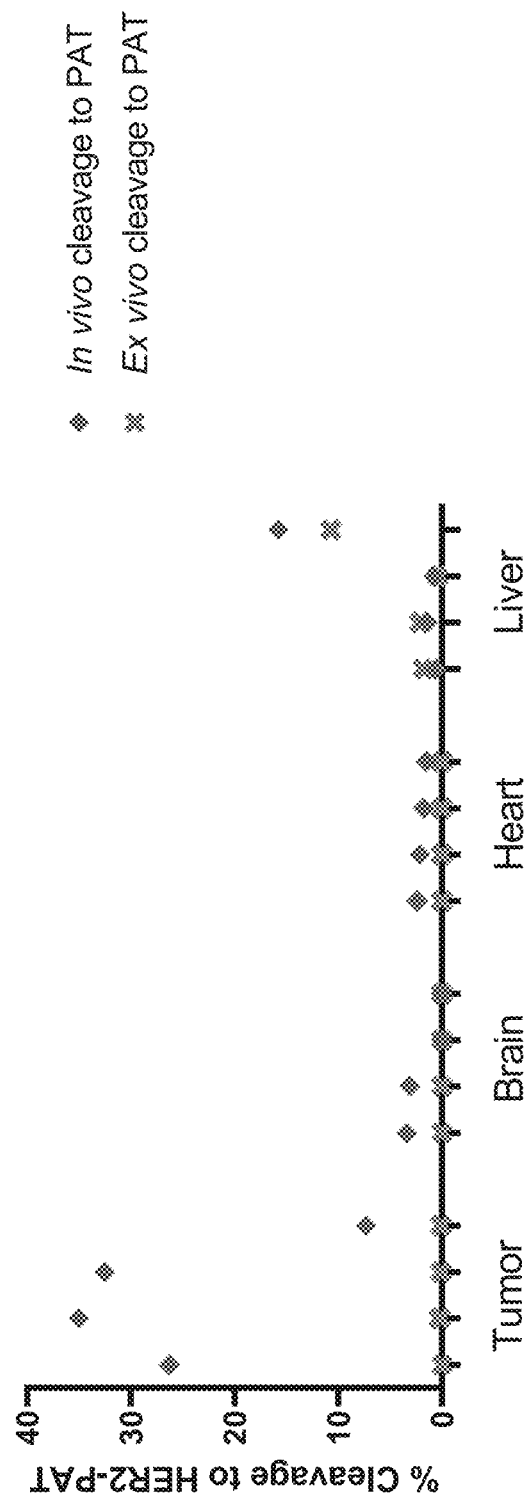

In additional in vivo experiments, it was demonstrated that HER2-XPAT (i.e., XTENylated or masked HER2-PAT) is preferentially unmasked in tumor tissue with significantly greater cleavage seen in tumors as compared to normal tissue. BT-474 tumors were established in NSG mice. The mice were injected with HER2-XPAT that was site-specifically labelled with an IR dye. After a period of 2 days, the tissue (tumor, brain, heart and liver) was harvested, homogenized and the presence of unmasked HER2-PAT in the various tissues of the BT-474 was assessed. Further, in order to determine whether the cleavage/unmasking of the HER2-XPAT occurred in vivo in the tumor or whether it was an artefact of the homogenization of the tissue once the tissue had been harvested, the samples were spiked with a differently labeled HER2-XPAT prior to same preparation. FIG. 7D demonstrates that there is preferential cleavage of HER2-XPAT to the unmasked PAT in the tumor tissue as compared to the cleavage seen in the brain, heart, and liver tissue. Further, FIG. 7D also shows that the cleavage occurred in vivo in the tissue as opposed to ex vivo as a result of homogenization or other handling. In addition, there is strong evidence of XPAT cleavage in fresh tumor samples.

Examples 11a-11c demonstrate that cleavable XTENylated HER2-PAT induces robust tumor regression in tumor models that express low levels of HER2 as well as tumors that are characterized with high HER2 expression. As such tumor regression is not observed in the test subjects treated with non-cleavable XPAT. Moreover, the data presented herein show that HER2-XPAT is preferentially unmasked in vivo, in the tumor microenvironment. The experimental design for Examples 11a-11c are further discussed below in Example 17.

Example 12. Lymphocyte Margination Induced in Subjects by Administration of XTENylated XPATs This example illustrates lymphocyte margination induced in subjects (e.g., female and male monkeys) by administration of an XTENylated HER2-PAT (e.g., as set forth in Table 6), for example, a single-dose intravenous (IV) infusion (e.g., at 25 mg/kg at a dose volume of 10 ml/kg).

Test article dosing formulations were prepared by diluting the XPAT-of-interest according to established protocols to meet dose level requirements. The test article (the HER2-XPAT of interest) and the appropriate diluent were provided as single-use aliquots and stored in a freezer set to maintain −80° C. until use. Once thawed, aliquots were stored at 2° C.-8° C. and were not refrozen. The dosing formulations were prepared on the day of dosing. On the day of use, an aliquot of XPAT stock solution and the appropriate diluent was thawed at room temperature and an appropriate amount of test article was diluted to obtain the proper concentration. The dosing formulation was mixed by inverting the tube gently several times. The IV route of exposure was selected as a candidate route of human exposure.

Figure 8:
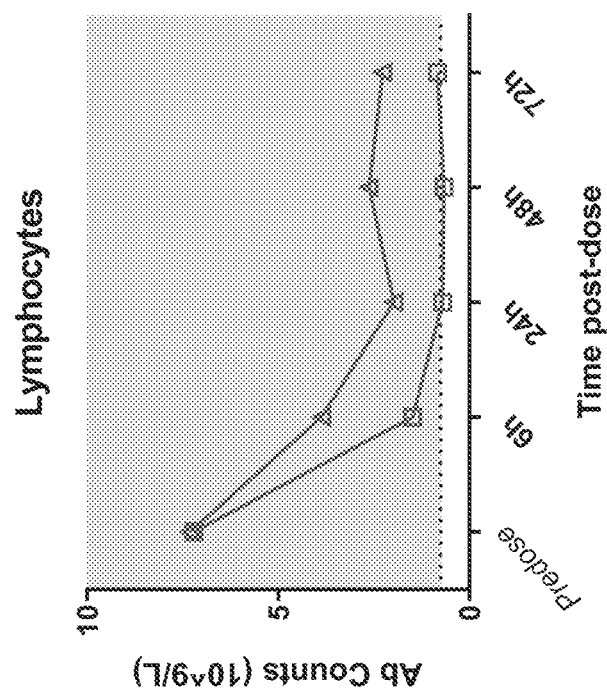
FIG. 8 illustrates lymphocyte margination induced in subjects by administration of XTENylated HER2-XPATs. For example, upon a single-dose intravenous infusion (e.g., 25 mg/kg at a dose volume of 10 ml/kg) of an XTENylated, HER2-XPAT (e.g., set forth in Table D), a decrease in lymphocyte count (hematology) was observed, in both female and male monkey subjects (as indicated by triangles and squares, respectively), starting at 6 hours post-dose and lasting till at least 24-72 hours post-dose.

As shown in FIG. 8, the HER2-XPAT-related changes in hematology parameters following a single dose (25 mg/kg), including a decrease of lymphocytes (summarized in the table immediately below), were observed starting at 6 hours post-dose (0.5-0.2× of the pre-dose level) and sustained at 24 hours post-dose (0.27-0.1× of the pre-dose level) and at 48 h (0.09-0.36× of the pre-dose level). At 72 hr post-dose, the lymphocyte level remained low (0.3-0.1× of the pre-dose level).

TABLE 14

Hematology: lymphocyte changes associated with HER2-XPAT administration

| | | Dose (25 mg/kg) | |
|---|---|---|---|
| Parameter | Time Point | M | F |
| Lymphocyte count | Pre-dose | 7.22 | 7.31 |
| | 6 hours post-dose | 1.49 | 3.87 |
| | 24 hours post-dose | 0.7 | 1.98 |
| | 48 hours post-dose | 0.67 | 2.63 |
| | 72 hours post-dose | 0.84 | 2.27 |

Figure 9A:
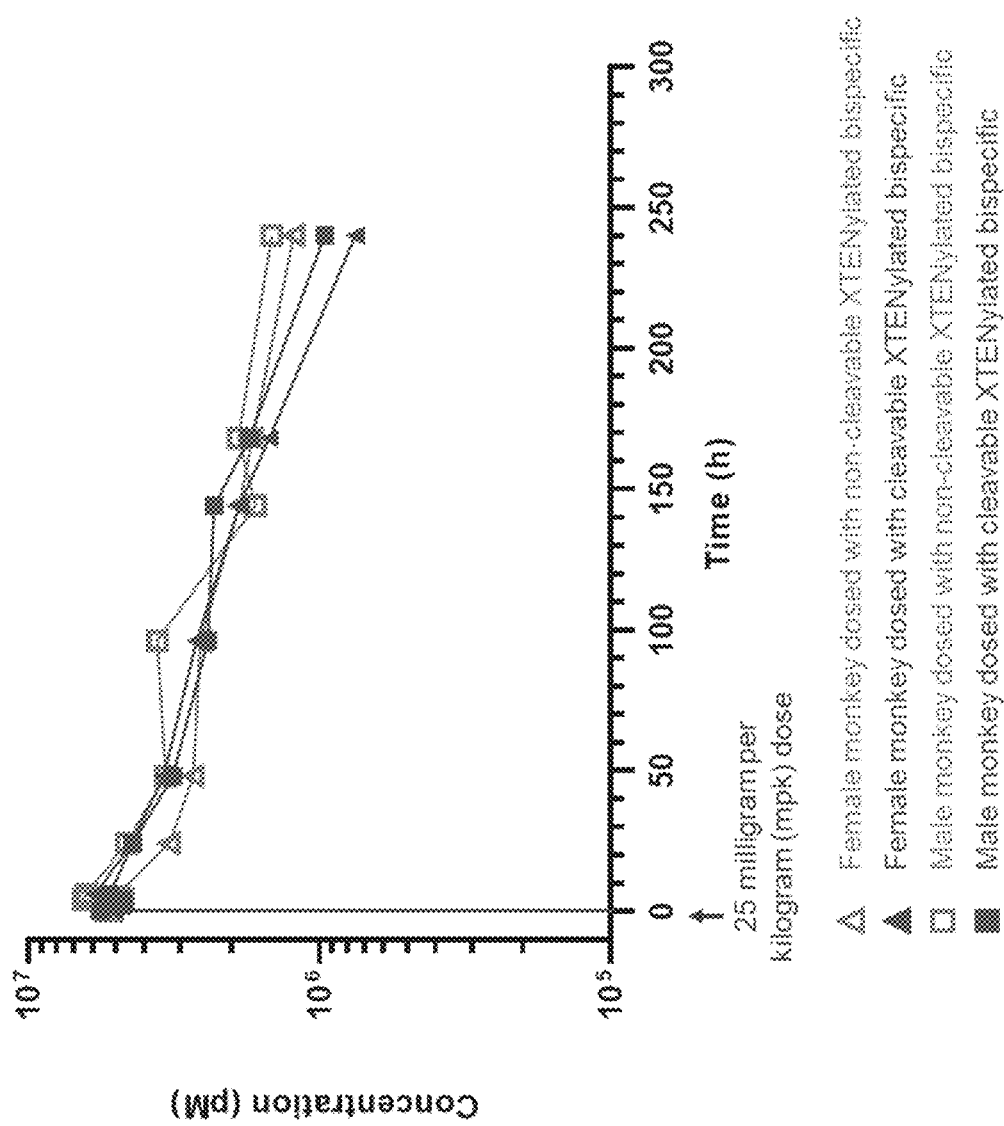
FIGS. 9A-9B.
Figure 9B:
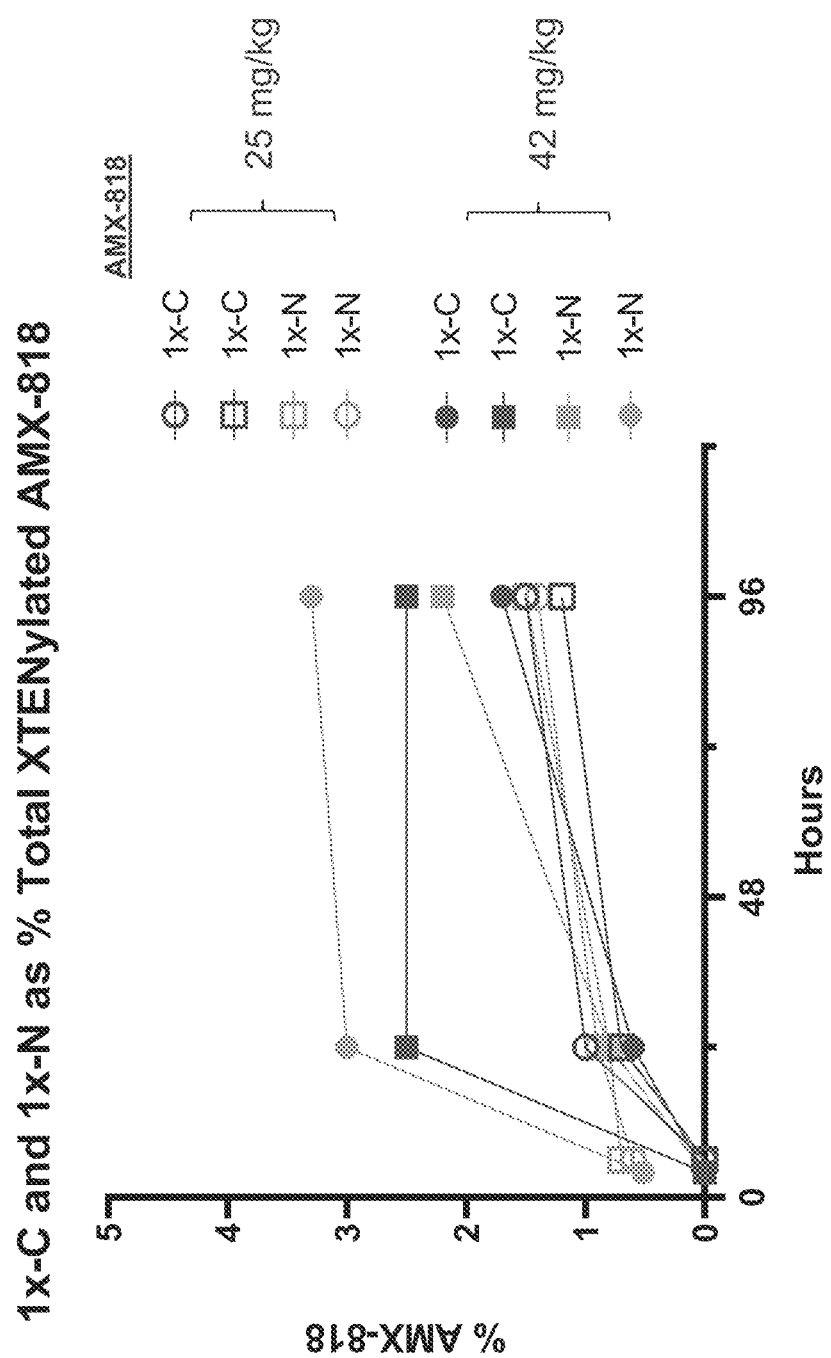

Example 13. Evaluation of Toxicity and Pharmacokinetics of XTENylated PATs (XPATs) in Subjects Toxicity and pharmacokinetics of XTENylated HER2-PAT (e.g., set forth in Table D) were assessed in cynomolgus monkeys. Animals were dosed with 25 mg/kg of a cleavable XTENylated HER2-PAT or a corresponding non-cleavable XTENylated counterpart over 1 hour. Blood for plasma was collected at pre-dose and post end of infusion at: 5 min, 2 hrs, 4 hrs, 6 hrs, 24 hrs, 48 hrs, 96 hrs, 144 hrs, 168 hrs, and 240 hrs. All blood was collected on time+/−2 minutes. Plasma samples were analyzed for the concentration of the cleavable and non-cleavable XTENylated bispecific constructs. The plasma drug concentrations were measured by ECLIA (electrochemiluminescent immunoassay) using recombinant HER2 as capture and an antibody directed against the XTEN mask for detection. As shown in FIG. 9, in cynomolgus monkeys, the HER2-XPAT (e.g., set forth in Table D) showed a pharmacokinetic profile analogous to the corresponding non-cleavable version due to its stability in peripheral tissues. The non-cleavable constructs used in the experiments are identical to the corresponding cleavable constructs, but for the fact that the release site has been replaced with a non-cleavable sequence of similar length made from GASTEP amino acids (glycine, alanine, serine, threonine, glutamate, and/or proline). The presence of proteolytic metabolites in circulation after two separate doses was also monitored and shown in FIG. 9B as a percentage of the total HER2-XPAT. As shown in FIG. 9B the presence of the 1×-metabolites is less than 4% of the total HER2-XPAT.

Example 14. XTEN Masking Expands Safety Margin of HER2-XPAT Vs. HER2-PAT

Figure 10A:
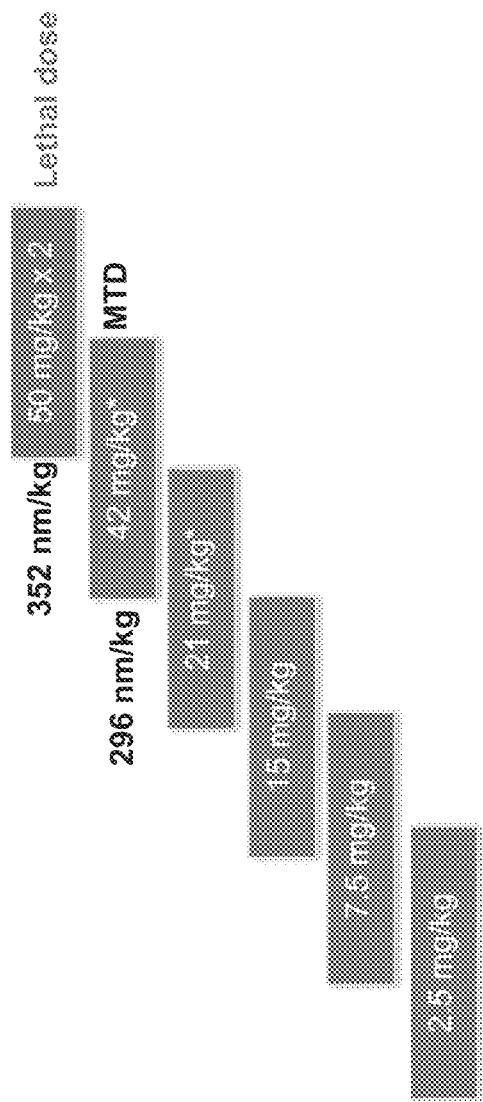
FIGS. 10A-10C.
Figure 10B:
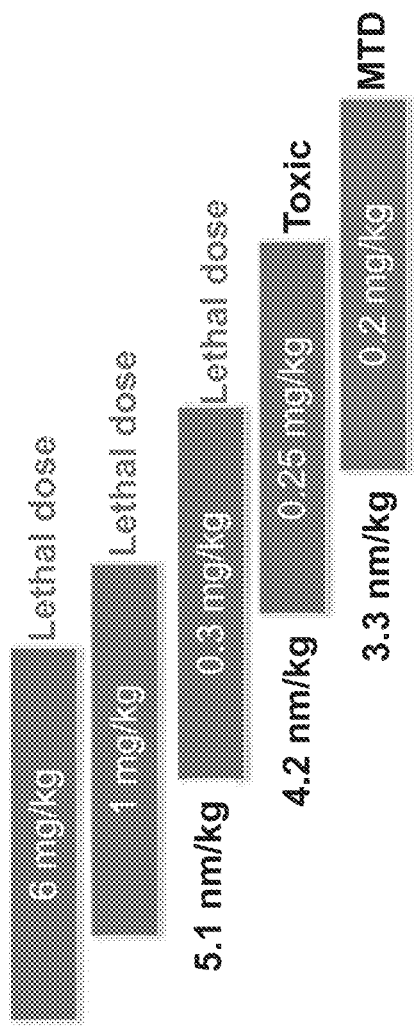
Figure 10C:
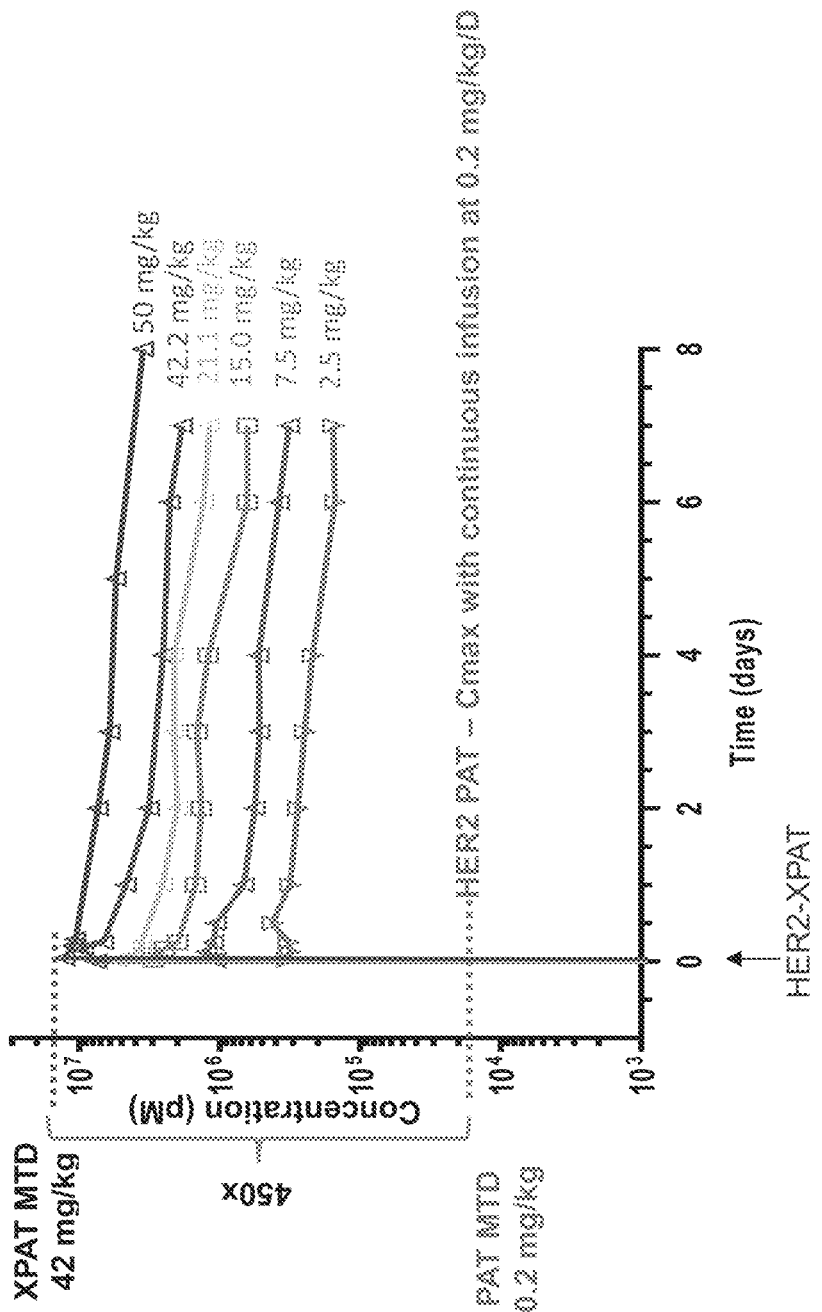

Additional data shows that HER2-XPAT is well-tolerated in cynomolgus monkeys and the presence of the provides a 450-fold higher tolerated Cmax as compared to that seen with unmasked PAT. HER2-XPAT was administered IV, single dose/animal (doses 2.5-42 mpk) and weekly ×2 at 50 mpk. *At doses 21 mpk and above, a variant of HER2-XPAT with a shorter C-terminal XTEN mask was used. HER2-PAT was administered by continuous infusion due to its short half-life. Plasma concentrations of HER2-XPAT were measured by ECLIA* using recombinant HER2 capture and an antibody directed against the XTEN mask for detection. The Cmax values for HER2 PAT were determined by ECLIA utilizing an a-idiotypic Ab directed against the a-CD3 scFv as capture and recombinant HER2 as detection. *ECLIA=Electrochemiluminescent Immunoassay. FIG. 10A shows the maximum tolerated dose of 42 mg/kg, indeed no overt CRS was seen even at 50 mg/kg. Conversely, in FIG. 10B the maximum tolerated dose of the unmasked HER2-PAT is 0.2 mg/kg. FIG. 10C shows the plasma concentrations of masked HER2-PAT (at a 450-fold higher tolerated Cmax) as compared to unmasked HER2-PAT.

In FIG. 13A-FIG. 13B there is additional evidence supporting the safety profile of a preferred HER2-XPAT of the present invention. HER2-XPAT or its non-cleavable counterpart, HER2-XPAT-NoClvSite were administered as a single IV dose of 25 or 42 mg/kg. Dose normalized plasma drug concentrations were measured by ECLIA* using recombinant HER2 as capture and an antibody directed against the XTEN mask for detection. *ECLIA=Electrochemiluminescent Immunoassay. The data in FIG. 12A shows a comparable PK between HER2-XPAT and the non-cleavable HER2-PAT formats, demonstrating that the protease release site remains largely stable in circulation of cynomolgus monkeys even at high doses. In FIG. 12B, concentrations of singly-cleaved HER2-XPAT(1X-C) and HER2-XPAT(1X-N) were measured in plasma from cynomolgus monkeys administered HER2-XPAT. Quantitative Western was performed using an antibody recognizing the anti-HER2 scFv with standards prepared with recombinant versions of the singly-cleaved molecules. Results are expressed as a percentage of the total XTENylated species as measured by ECLIA as described above. FIG. 12B shows that even at high dose of HER2 XPAT there is very limited systemic accumulation of metabolites lacking one or both XTEN masks.

Example 15. HER2-XPAT does not Induce Cytokine Release Syndrome

Consistent with the tolerability of HER2-XPAT, the present Example demonstrates that HER2-XPAT in pilot NHP toxicology studies led to minimal T cell activation in circulation in NHPs, while its unmasked counterpart led to significant T cell activation even at much lower doses. Consistent with this masking of T cell activation, cytokine release upon administration of HER2-XPAT was also robustly attenuated relative to what was observed with its unmasked counterpart. There was no overt Cytokine Release Syndrome (CRS) with HER2-XPAT, even at the MTD of 42 mg/kg, while its unmasked TCE counterpart caused death due to CRS at doses as low as 0.3 mg/kg. Overall, AMX-818 was well-tolerated in NHP studies at doses that would be significantly higher than anticipated clinically relevant doses, and there were no gross or microscopic findings in HER2-expressing tissues such as the heart, where other approved HER2-targeted agents have demonstrated clinical toxicity.

Figure 11A:
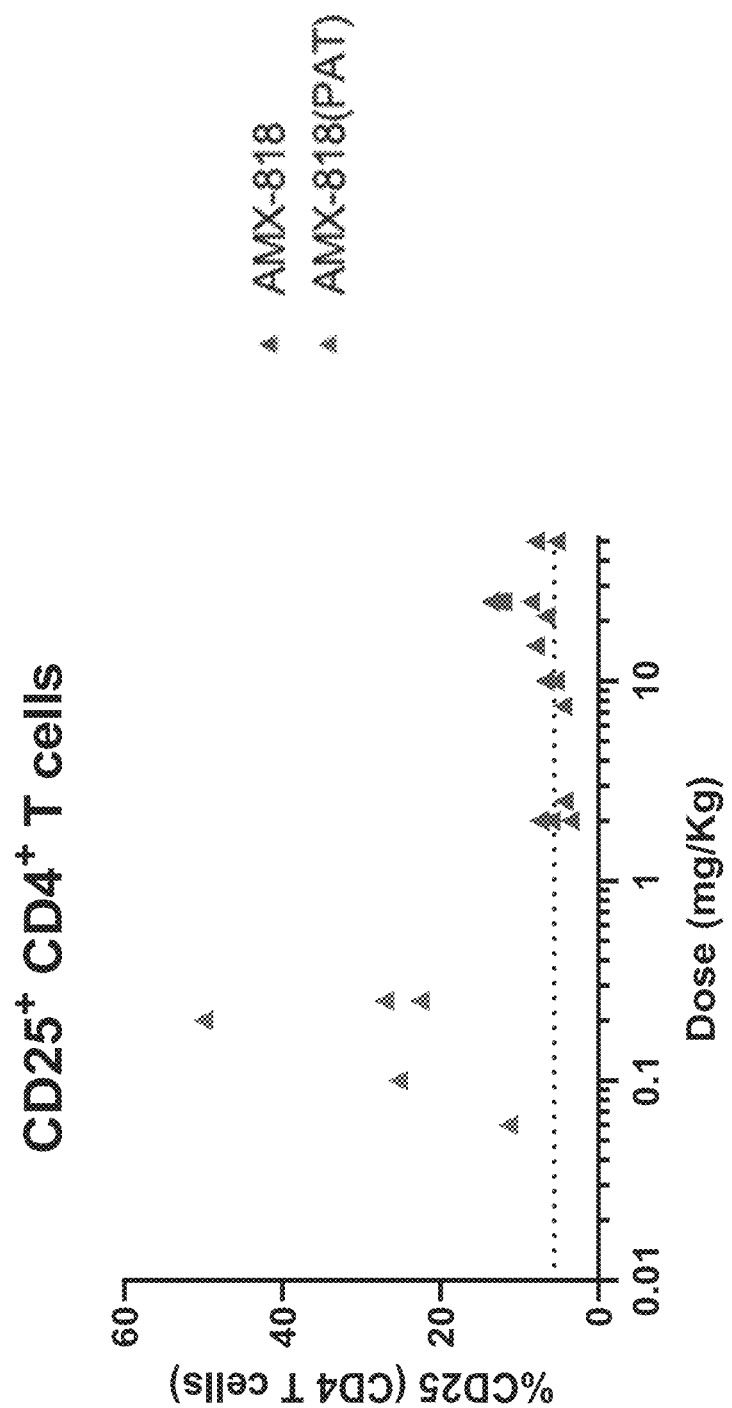
FIGS. 11A-11E.
Figure 11B:
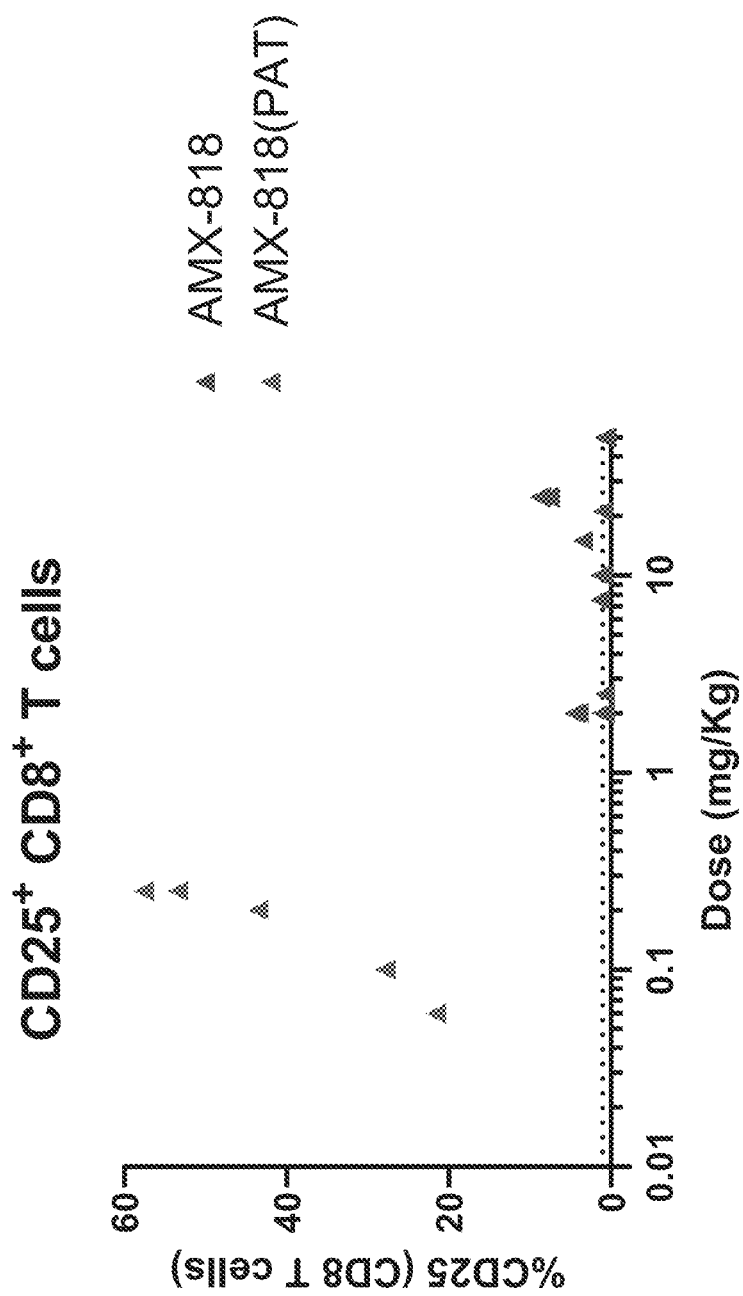

Thus, even at 50 mg/kg, administration of HER2-XPAT did not induce cytokine release or systemic T cell activation. This supports that there is minimal CRS risk for XPATs vs standard TCEs. Only 1-3% of singly-cleaved XPAT metabolites were detected in plasma from NHP administered high doses of HER2-XPAT (25 & 42 mg/kg). For this study, peripheral T cell activation (% CD25+) was evaluated by flow cytometry 24 hours post-HER2-XPAT treatment. FIGS. 11A and 11B show CD25+CD4+ T cell (FIG. 11A) and CD25+CD8+(FIG. 11B) T cell in the presence of HER2-XPAT vs. HER2-PAT.

Figure 11C:
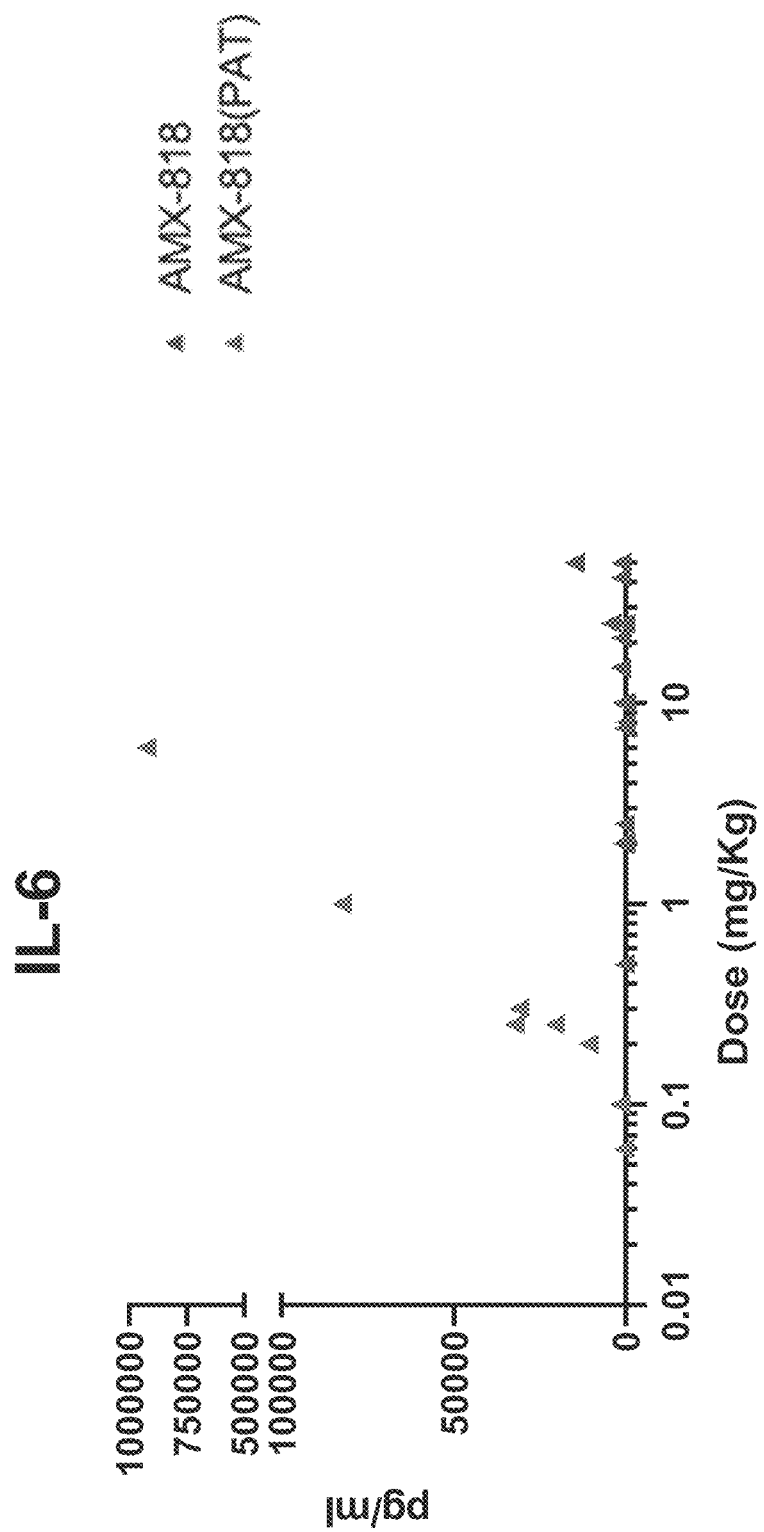
Figure 11D:
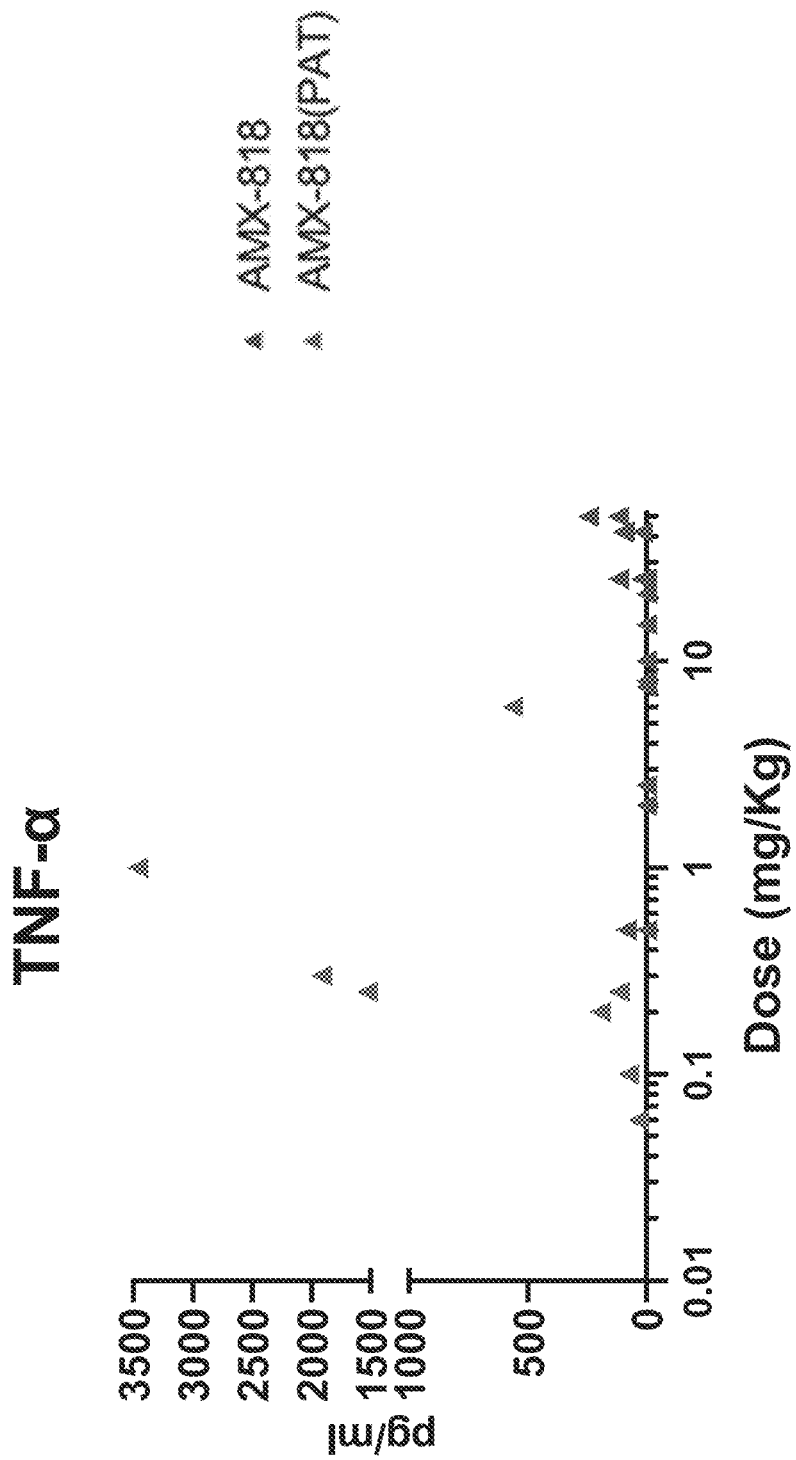
Figure 11E:
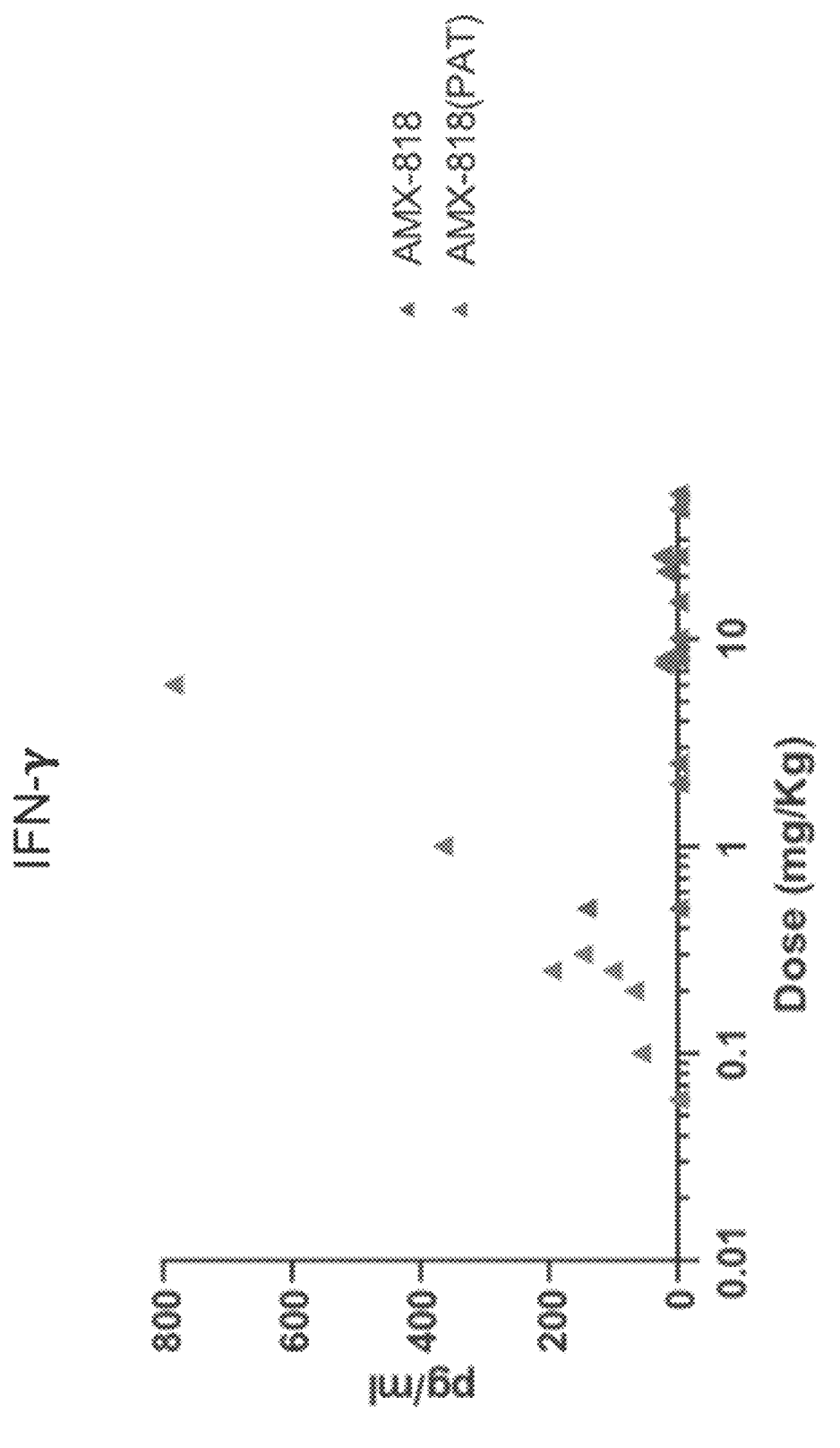

Cytokine analysis was performed with a Luminex® suspension array system on plasma samples. FIGS. 11C-11E show the IL-6 (FIG. 11C), TNF-α (FIG. 11D) and IFN-g (FIG. 11E) levels in plasma in response to HER2-XPAT vs HER2-PAT. Data presented are maximal values measured between 6-24 hours at each evaluated dose. In additional GLP toxicology studies (data not shown), NHPs were dosed weekly with AMX-818 at 3 dose levels (0.5 mg/kg, 2 mg/kg and 6 mg/kg) over a 31-day period. The results from these GLP toxicology studies are consistent with the prior pilot NHP studies and there were no AMX-818 related adverse findings based on standard toxicology endpoints, including histopathologic examination, and all clinical pathological findings were reversible.

Also consistent with the safety of AMX-818 in NHPs up to 42 mg/kg, AMX-818 is largely stable in circulation where protease inhibitors are abundant, as evidenced by the limited systemic accumulation of active metabolites. Because healthy NHPs were dosed and subjects to be treated with AMX-818 also may have systemic inflammation, the stability of AMX-818 was analyzed ex vivo in plasma samples taken from patients with cancer and inflammatory disease, as well as NHPs in which we induced systemic inflammation. As shown in FIG. 12, similar AMX-818 stability was observed in plasma samples from healthy NHPs, inflamed NHPs, healthy humans, and human patients with cancer or inflammatory disease in a stability study in which we incubated AMX-818 with plasma samples for seven days at 37° C.

For this experiment, AMX-818 with a fluorescent label (DyL650) attached to the tandem scFv was incubated in the indicated plasma samples for seven days at 37° C. Samples were then run on a gel and metabolites similar in size to the unmasked, active form of AMX-818 were quantified using a LI-COR detector. Inflammatory disease human samples were derived from patients with rheumatoid arthritis, lupus, inflammatory bowel disease, and multiple sclerosis. Cancer human samples were derived from patients with lung, breast, and colon tumors. Sample sizes: Healthy NHP N=4, Healthy Human N=4, "Inflamed" NHP N=6, "Inflamed" Human N=27, Cancer Human N=11.

Across all four plasma groups, the range of products similar in size to the active, unmasked HER2 TCE was only approximately two to four percent of the total AMX-818 species present. This small percentage reflects an overestimate of potential accumulation of unmasked TCE in vivo, as renal filtration will rapidly eliminate such products from circulation (half-life of the unmasked form in NHP is approximately seven hours). These data suggest limited risk of significant systemic accumulation of the active, unmasked form of AMX-818 in cancer patients.

Example 16. AMX-818 and 818-PAT Induce Surface Expression of PD-1 and CD69 on T Cells in Response to SKOV3 Tumor Cells Surface PD-1 expression was evaluated on CD4+ and CD8+ T cells by flow cytometry following a 48 hour co-incubation of PBMCs and SKOV3 cells at a 5:1 Effector: Target ratio with test articles at the indicated concentrations. On both CD4 and CD8 T cell subsets, 818-PAT and AMX-818 increased the frequency of T cells expressing surface PD-1, with the AMX-818 curve shifted approximately 2.5-logs relative to 818-PAT, demonstrating significant masking by the prodrug relative to its activated counterpart. Maximal activation of the T cells by AMX-818(PAT) was achieved at 625 pM concentrations, while maximal activation by AMX-818 was achieved at 150-600 nM concentrations.

Histogram plots comparing the surface levels of PD-1 on CD4 and CD8 T cells at the indicated drug concentrations are shown in FIG. 14A-14D.

AMX-818(PAT) and prodrug AMX-818 induced CD69 and PD-1 expression on the surface both CD4+ and CD8+ T-cell subsets to comparable degrees. However, the dose-response curve for AMX-818 was shifted on average >400-fold higher relative to that of the activated AMX-818(PAT), demonstrating effective functional masking of AMX-818 (data shown for CD8 T cells in FIG. 14A and FIG. 14C). Maximal upregulation of activation marker CD69 and inhibitory receptor PD-1 by AMX-818(PAT) was observed at 0.62 nM concentrations, while comparable induction by AMX-818 required 150-600 nM concentrations (FIGS. 14B and 14D).

AMX-818(PAT) also potently induced surface expression of PD-L1 on SKOV3 tumor cells with an $EC_{50}$ value of 19.7 pM, while XTENylated AMX-818 was 650-fold less potent in inducing comparable frequency and levels of PD-L1 (see FIG. 15A-15C). The induction of PD-1 on T cells and PD-L1 on target tumor cells by AMX-818 is expected to dampen its activity and provides rationale for combining a PD-1 blocking therapy to AMX-818 in future clinical investigations.

AMX-818(PAT) and AMX-818 induced PD-1 to comparable levels and maximal percentages within both human CD4+ and CD8+ T-cell subsets. However, AMX-818 was on average >400-fold less potent than AMX-818(PAT). AMX-818(PAT) potently induced surface expression of PD-L1 on HER2-high expressing SKOV3 tumor cells with an $EC_{50}$ value of 19.7 pM, while AMX-818 was >650-fold less potent for comparable induction. The induction of PD-1 on T cells and PD-L1 on target tumor cells by AMX-818 is expected to dampen its activity and provides the rationale for a combination of PD-1 blocking therapy with AMX-818.

Example 17. XPATs are Unmasked to TCEs in Human Tumors Implanted in Living Mice, with Minimal Cleavage Observed in Healthy Tissues The present example summarizes the potent in vivo efficacy of the HER2-XPATS of the present invention. To assess anti-tumor activity, immunocompromised mice were injected with tumor cells expressing the target of interest. When the tumors were sufficiently large and well-established (over 100 mm³), human PBMCs were injected and intravenous dosing of the HER2-XPATs and a variety of control molecules was initiated. These studies showed that the HER2 targeting XPATs drove tumor regressions and a number of complete responses. An AMX-818 variant lacking the protease-cleavable linker had no activity, indicating that protease cleavage of the linker drove activity.

Moreover, the HER2-XPAT expand the safety margin in vivo. HER2 has relatively limited expression in healthy tissues. When NHPs were injected with the HER2-XPATs, as well as their unmasked TCE counterparts, and tolerability was assessed to determine the maximum tolerated dose of each molecule. XTEN masks on the XPATs significantly increased the tolerability of the TCEs, enabling an over 400-fold higher Cmax at MTD relative to what is observed with the unmasked HER2 TCE. To provide evidence that the protease-cleavable linker can be cleaved across a broad range of human tumors, XPAT cleavage was analyzed in fresh human tumor samples, as well as patient-derived and xenograft tumors. In fresh human tumors explants, an XPAT induced protease-cleavable linker-dependent release of cytokines from tumor resident T cells, similar to the cytokine release induced by a positive control (anti-CD3 antibody) that directly activated T cells.

To quantify the degree of preferential unmasking of XPATs that occurs in tumors, XPAT cleavage was assessed in living mice. A fluorophore labeled XPAT was injected into mice, and two days later harvested tumors and healthy tissues to measure levels of XPAT and cleavage products. To specifically quantify cleavage occurring in the living mouse, and control for any cleavage occurring after tissues were harvested, we also analyzed cleavage of a control XPAT added during tissue processing. Across 31 mice with nine different tumor types, on average, 20% of the XPAT in tumors of living mice was cleaved to the unmasked TCE form, while minimal cleavage of XPATs was observed in healthy tissues. The demonstration that there was limited-to-no cleavage of the control XPAT confirms that cleavage of the injected XPAT occurred in the living mice, not during tissue processing. The study design and data are shown in FIG. 16A-C.

While preferred embodiments of the present invention have been shown and described herein, it will be obvious to those skilled in the art that such embodiments are provided by way of example only. It is not intended that the invention be limited by the specific examples provided within the specification. While the invention has been described with reference to the aforementioned specification, the descriptions and illustrations of the embodiments herein are not meant to be construed in a limiting sense. Numerous variations, changes, and substitutions will now occur to those skilled in the art without departing from the invention. Furthermore, it shall be understood that all aspects of the invention are not limited to the specific depictions, configurations or relative proportions set forth herein which depend upon a variety of conditions and variables. It should be understood that various alternatives to the embodiments of the invention described herein may be employed in practicing the invention. It is therefore contemplated that the invention shall also cover any such alternatives, modifications, variations or equivalents. It is intended that the following claims define the scope of the invention and that methods and structures within the scope of these claims and their equivalents be covered thereby.

SEQUENCE LISTING (8022 sequences)

SEQ ID NO: 1 - protein, 14 aa, synthetic construct
  REGION 1..14: note = Synthetic
RSSNGAVTSSNYAN

SEQ ID NO: 2 - protein, 14 aa, synthetic construct
  REGION 1..14: note = Synthetic
RSSNGEVTTSNYAN

SEQ ID NO: 3 - protein, 14 aa, synthetic construct
  REGION 1..14: note = Synthetic
RSSTGAVTTSNYAN

SEQ ID NO: 4 - protein, 7 aa, synthetic construct
  REGION 1..7: note = Synthetic
GTNKRAP

SEQ ID NO: 5 - protein, 7 aa, synthetic construct
  REGION 1..7: note = Synthetic
GTIKRAP

SEQ ID NO: 6 - protein, 10 aa, synthetic construct
  REGION 1..10: note = Synthetic
ALWYPNLWVF

SEQ ID NO: 7 - protein, 10 aa, synthetic construct
  REGION 1..10: note = Synthetic
ALWYSNLWVF

SEQ ID NO: 8 - protein, 10 aa, synthetic construct
  REGION 1..10: note = Synthetic
GFTFNTYAMN

SEQ ID NO: 9 - protein, 19 aa, synthetic construct
  REGION 1..19: note = Synthetic
RIRSKYNNYATYYADSVKD

SEQ ID NO: 10 - protein, 14 aa, synthetic construct
  REGION 1..14: note = Synthetic
HENFGNSYVSWFAH

SEQ ID NO: 11 - protein, 14 aa, synthetic construct
  REGION 1..14: note = Synthetic
HGNFGNSYVSWFAY

SEQ ID NO: 12 - protein, 2024 aa, synthetic construct
  REGION 1..2024: note = Synthetic
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPLGGRADNHEPPELGAGATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGSELVVTQEPSLTVSPGGTVTLTCRSSTGAVTTSNYANWVQQKPGQAPRGLIGGTNKRAPGTPARFSGSSLGGSAALTLSGVQPEDEAEYYCALWYSNLWVFGGGTKLTVLGATPPETGAETESPGETTGGSAESEPPGEGEVQLQESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGLGGRADNHEPPELGAGSAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSTETPGSPAGSPTSTEEGTSESATPESGPGTSTEPSEGSAPGTSTEPSEGSAPGSPAGSPTSTEEGTSTEPSEGSAPGTATESPEGSAPGTSESATPESGPGTSTEPSEGSAPGTSAESATPESGPGSEPATSGSETPGTSTEPSEGSAPGTSTEPSEGSAPGTSESATPESGPGTESAS

SEQ ID NO: 13 - protein, 1452 aa, synthetic construct
  REGION 1..1452: note = Synthetic
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGEEPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPASTRGENAGPAGLEAPATSGSETPGTDIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGASTRGENAGPAGLEAPPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 14 - protein, 1446 aa, synthetic construct
  REGION 1..1446: note = Synthetic
ASSPAGSPTSTESGTSESATPESGPGTETEPSEGSAPGTSESATPESGPGSEPATSGSETPGTSESATPESGPGSTPAESGSETPGTSESATPESGPGTSTEPSEGSAPGSPAGSPTSTEEGTSESATPESGPGESPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGRSANHTPAGLTGPATSGSETPGTEIVLTQSPATLSLSPGERATLSCKASQDVSIGVAWYQQKPGQAPRLLIYSASYRYSGVPARFSGSGSGTDFTLTISSLEPEDFAVYYCQQYYIYPYTFGQGTKVEIKGATPPETGAETESPGETTGGSAESEPPGEGQVQLVQSGVEVKKPGASVKVSCKASGFTFTDYTMDWVRQAPGQGLEWMADVNPNSGGSIYNQRFKGRVTLTTDSSTTTAYMELKSLQFDDTAVYYCARNLGPSFYFDYWGQGTLVTVSSGGGSELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGEAGRSANHTPAGLTGPTPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSESATSGSETPGSPAGSPTSTEEGTSTEPSEGSAPGTSTEPSEGSAPGSEPATSGSETPGTSESA

SEQ ID NO: 15 - protein, 1447 aa, synthetic construct
  REGION 1..1447: note = Synthetic
SPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPLFGRNDNHEPLELGGGATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGSELVVTQEPSLTVSPGGTVTLTCRSSTGAVTTSNYANWVQQKPGQAPRGLIGGTNKRAPGTPARFSGSSLGGSAALTLSGVQPEDEAEYYCALWYSNLWVFGGGTKLTVLGATPPETGAETESPGETTGGSAESEPPGEGEVQLQESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGLFGRNDNHEPLELGGGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPG

SEQ ID NO: 16 - protein, 1452 aa, synthetic construct
  REGION 1..1452: note = Synthetic
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPRTGRTGESANETPAGLGGPATSGSETPGTEIVLTQSPATLSLSPGERATLSCKASQDVSIGVAWYQQKPGQAPRLLIYSASYRYSGVPARFSGSGSGTDFTLTISSLEPEDFAVYYCQQYYIYPYTFGQGTKVEIKGATPPETGAETESPGETTGGSAESEPPGEGQVQLVQSGVEVKKPGASVKVSCKASGFTFTDYTMDWVRQAPGQGLEWMADVNPNSGGSIYNQRFKGRVTLTTDSSTTTAYMELKSLQFDDTAVYYCARNLGPSFYFDYWGQGTLVTVSSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGRTGRTGESANETPAGLGGPGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSTETGTSESATPESGPGSEPATSGSETPGTSESATPESGPGTSTEPSEGSAPGSPAGSPTSTEEGTSESATPESGPGSEPATS

SEQ ID NO: 17 - protein, 1446 aa, synthetic construct
  REGION 1..1446: note = Synthetic
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPGAGRTDNHEPLELGAAATSGSETPGTDIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGGAGRTDNHEPLELGAATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSESATSGSETPGSPAGSPTSTEEGTSTEPSEGSAPGTSTEPSEGSAPGSEPATSGSETPGTSESA

SEQ ID NO: 18 - protein, 2307 aa, synthetic construct
  REGION 1..2307: note = Synthetic
GSPAGSPTSTEEGTSESATPESGPGTSTEPSEGSAPGSPAGSPTSTEEGTSTEPSEGSAPGTSTEPSEGSAPGTSESATPESGPGSESATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPESGRAANTGPPTLTAPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGSELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGESGRAANTGPPTLTAPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPG

SEQ ID NO: 19 - protein, 1449 aa, synthetic construct
  REGION 1..1449: note = Synthetic
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPASGRSTNAGPPGLTGPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGASGRSTNAGPPGLTGPPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPG

SEQ ID NO: 20 - protein, 2304 aa, synthetic construct
  REGION 1..2304: note = Synthetic
SAGSPGSPAGSPTSTEEGTSESATPESGPGTSTEPSEGSAPGSPAGSPTSTEEGTSTEPSEGSAPGTSTEPSEGSAPGTSESATPESGPGSTPAESGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSTETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTESASLFGRNDNHEPLELGGGATSGSETPGTEIVLTQSPATLSLSPGERATLSCKASQDVSIGVAWYQQKPGQAPRLLIYSASYRYSGVPARFSGSGSGTDFTLTISSLEPEDFAVYYCQQYYIYPYTFGQGTKVEIKGATPPETGAETESPGETTGGSAESEPPGEGQVQLVQSGVEVKKPGASVKVSCKASGFTFTDYTMDWVRQAPGQGLEWMADVNPNSGGSIYNQRFKGRVTLTTDSSTTTAYMELKSLQFDDTAVYYCARNLGPSFYFDYWGQGTLVTVSSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGLFGRNDNHEPLELGGGEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESASPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESAT

SEQ ID NO: 21 - protein, 2023 aa, synthetic construct
  REGION 1..2023: note = Synthetic
GSPAGSPTSTEEGTSESATPESGPGTSTEPSEGSAPGSPAGSPTSTEEGTSTEPSEGSAPGTSTEPSEGSAPATSESATPESGPGSEPATSGSETPGSEPATSGSETPGSPAGSPTSTEEGTSESASPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTTGRAGEAEGATSAGATGPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGTTGRAGEAEGATSAGATGPGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSTETGTSESATPESGPGSEPATSGSETPGTSESATPESGPGTSTEPSEGSAPGSPAGSPTSTEEGTSESATPESGPGSEPATS

SEQ ID NO: 22 - protein, 1736 aa, synthetic construct
  REGION 1..1736: note = Synthetic
ASSPAGSPTSTESGTSESATPESGPGTETEPSEGSAPGTSESATPESGPGSEPATSGSETPGTSESATPESGPGSTPAESGSETPGTSESATPESGPGTSTEPSEGSAPGSPAGSPTSTEEGTSESATPESGPGESPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPASGRGTNAGPAGLTGPATSGSETPGTDIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGSELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGASGRGTNAGPAGLTGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPG

SEQ ID NO: 23 - protein, 1745 aa, synthetic construct
  REGION 1..1745: note = Synthetic
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGEEPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPGAGRTDNHEPLELGAAATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGSELVVTQEPSLTVSPGGTVTLTCRSSTGAVTTSNYANWVQQKPGQAPRGLIGGTNKRAPGTPARFSGSSLGGSAALTLSGVQPEDEAEYYCALWYSNLWVFGGGTKLTVLGATPPETGAETESPGETTGGSAESEPPGEGEVQLQESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGGAGRTDNHEPLELGAAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGFTABTSESATPESGPGSEPATSGPTESGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 24 - protein, 2304 aa, synthetic construct
  REGION 1..2304: note = Synthetic
SAGSPGSPAGSPTSTEEGTSESATPESGPGTSTEPSEGSAPGSPAGSPTSTEEGTSTEPSEGSAPGTSTEPSEGSAPGTSESATPESGPGSTPAESGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSTETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTESASASGRAANETPPGLTGAATSGSETPGTEIVLTQSPATLSLSPGERATLSCKASQDVSIGVAWYQQKPGQAPRLLIYSASYRYSGVPARFSGSGSGTDFTLTISSLEPEDFAVYYCQQYYIYPYTFGQGTKVEIKGATPPETGAETESPGETTGGSAESEPPGEGQVQLVQSGVEVKKPGASVKVSCKASGFTFTDYTMDWVRQAPGQGLEWMADVNPNSGGSIYNQRFKGRVTLTTDSSTTTAYMELKSLQFDDTAVYYCARNLGPSFYFDYWGQGTLVTVSSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGASGRAANETPPGLTGAGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSTETGTSESATPESGPGSEPATSGSETPGTSESATPESGPGTSTEPSEGSAPGSPAGSPTSTEEGTSESATPESGPGSEPATS

SEQ ID NO: 25 - protein, 2016 aa, synthetic construct
  REGION 1..2016: note = Synthetic
GSPAGSPTSTEEGTSESATPESGPGTSTEPSEGSAPGSPAGSPTSTEEGTSTEPSEGSAPGTSTEPSEGSAPATSESATPESGPGSEPATSGSETPGSEPATSGSETPGSPAGSPTSTEEGTSESASPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASGRSTNAGPPGLTGPATSGSETPGTEIVLTQSPATLSLSPGERATLSCKASQDVSIGVAWYQQKPGQAPRLLIYSASYRYSGVPARFSGSGSGTDFTLTISSLEPEDFAVYYCQQYYIYPYTFGQGTKVEIKGATPPETGAETESPGETTGGSAESEPPGEGQVQLVQSGVEVKKPGASVKVSCKASGFTFTDYTMDWVRQAPGQGLEWMADVNPNSGGSIYNQRFKGRVTLTTDSSTTTAYMELKSLQFDDTAVYYCARNLGPSFYFDYWGQGTLVTVSSGGGSELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGASGRSTNAGPPGLTGPGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSTETGTSESATPESGPGSEPATSGSETPGTSESATPESGPGTSTEPSEGSAPGSPAGSPTSTEEGTSESATPESGPGSEPATS

SEQ ID NO: 26 - protein, 1454 aa, synthetic construct
  REGION 1..1454: note = Synthetic
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGEEPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPRTGRTGESANETPAGLGGPATSGSETPGTEIVLTQSPATLSLSPGERATLSCKASQDVSIGVAWYQQKPGQAPRLLIYSASYRYSGVPARFSGSGSGTDFTLTISSLEPEDFAVYYCQQYYIYPYTFGQGTKVEIKGATPPETGAETESPGETTGGSAESEPPGEGQVQLVQSGVEVKKPGASVKVSCKASGFTFTDYTMDWVRQAPGQGLEWMADVNPNSGGSIYNQRFKGRVTLTTDSSTTTAYMELKSLQFDDTAVYYCARNLGPSFYFDYWGQGTLVTVSSGGGSELVVTQEPSLTVSPGGTVTLTCRSSTGAVTTSNYANWVQQKPGQAPRGLIGGTNKRAPGTPARFSGSSLGGSAALTLSGVQPEDEAEYYCALWYSNLWVFGGGTKLTVLGATPPETGAETESPGETTGGSAESEPPGEGEVQLQESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGRTGRTGESANETPAGLGGPPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPG

SEQ ID NO: 27 - protein, 1744 aa, synthetic construct
  REGION 1..1744: note = Synthetic
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPLFGRNDNHEPLELGGGATSGSETPGTDIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGLFGRNDNHEPLELGGGPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGFTABTSESATPESGPGSEPATSGPTESGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 28 - protein, 2030 aa, synthetic construct
  REGION 1..2030: note = Synthetic
ASSPAGSPTSTESGTSESATPESGPGTETEPSEGSAPGTSESATPESGPGSEPATSGSETPGTSESATPESGPGSTPAESGSETPGTSESATPESGPGTSTEPSEGSAPGSPAGSPTSTEEGTSESATPESGPGESPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPTTGRAGEAANATSAGATGPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGTTGRAGEAANATSAGATGPSAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSTETPGSPAGSPTSTEEGTSESATPESGPGTSTEPSEGSAPGTSTEPSEGSAPGSPAGSPTSTEEGTSTEPSEGSAPGTATESPEGSAPGTSESATPESGPGTSTEPSEGSAPGTSAESATPESGPGSEPATSGSETPGTSTEPSEGSAPGTSTEPSEGSAPGTSESATPESGPGTESAS

SEQ ID NO: 29 - protein, 1450 aa, synthetic construct
  REGION 1..1450: note = Synthetic
SPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPTTGRATEAANATPAGLTGPATSGSETPGTDIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGSELVVTQEPSLTVSPGGTVTLTCRSSTGAVTTSNYANWVQQKPGQAPRGLIGGTNKRAPGTPARFSGSSLGGSAALTLSGVQPEDEAEYYCALWYSNLWVFGGGTKLTVLGATPPETGAETESPGETTGGSAESEPPGEGEVQLQESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGTTGRATEAANATPAGLTGPTPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSESATSGSETPGSPAGSPTSTEEGTSTEPSEGSAPGTSTEPSEGSAPGSEPATSGSETPGTSESA

SEQ ID NO: 30 - protein, 2022 aa, synthetic construct
  REGION 1..2022: note = Synthetic
GSPAGSPTSTEEGTSESATPESGPGTSTEPSEGSAPGSPAGSPTSTEEGTSTEPSEGSAPGTSTEPSEGSAPGTSESATPESGPGSESATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTTARAGSAENLSPSGLTGPATSGSETPGTDIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGSELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGTTARAGSAENLSPSGLTGPEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESASPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESAT

SEQ ID NO: 31 - protein, 2312 aa, synthetic construct
  REGION 1..2312: note = Synthetic
GSPAGSPTSTEEGTSESATPESGPGTSTEPSEGSAPGSPAGSPTSTEEGTSTEPSEGSAPGTSTEPSEGSAPGTSESATPESGPGSESATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPTTGRAGEAEGATSAGATGPATSGSETPGTDIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGTTGRAGEAEGATSAGATGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPG

SEQ ID NO: 32 - protein, 1751 aa, synthetic construct
  REGION 1..1751: note = Synthetic
ASSPAGSPTSTESGTSESATPESGPGTETEPSEGSAPGTSESATPESGPGSEPATSGSETPGTSESATPESGPGSTPAESGSETPGTSESATPESGPGTSTEPSEGSAPGSPAGSPTSTEEGTSESATPESGPGESPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPPTGRSGEGANATPSGLTGPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGPTGRSGEGANATPSGLTGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGFTABTSESATPESGPGSEPATSGPTESGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 33 - protein, 1447 aa, synthetic construct
  REGION 1..1447: note = Synthetic
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPLGGRADNHEPPELGAGATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGLGGRADNHEPPELGAGTPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSESATSGSETPGSPAGSPTSTEEGTSTEPSEGSAPGTSTEPSEGSAPGSEPATSGSETPGTSESA

SEQ ID NO: 34 - protein, 1453 aa, synthetic construct
  REGION 1..1453: note = Synthetic
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGRSANHTPAGLTGPATSGSETPGTDIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGEAGRSANHTPAGLTGPPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 35 - protein, 1452 aa, synthetic construct
  REGION 1..1452: note = Synthetic
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPGAGRTDNHEPLELGAAATSGSETPGTEIVLTQSPATLSLSPGERATLSCKASQDVSIGVAWYQQKPGQAPRLLIYSASYRYSGVPARFSGSGSGTDFTLTISSLEPEDFAVYYCQQYYIYPYTFGQGTKVEIKGATPPETGAETESPGETTGGSAESEPPGEGQVQLVQSGVEVKKPGASVKVSCKASGFTFTDYTMDWVRQAPGQGLEWMADVNPNSGGSIYNQRFKGRVTLTTDSSTTTAYMELKSLQFDDTAVYYCARNLGPSFYFDYWGQGTLVTVSSGGGSELVVTQEPSLTVSPGGTVTLTCRSSTGAVTTSNYANWVQQKPGQAPRGLIGGTNKRAPGTPARFSGSSLGGSAALTLSGVQPEDEAEYYCALWYSNLWVFGGGTKLTVLGATPPETGAETESPGETTGGSAESEPPGEGEVQLQESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGGAGRTDNHEPLELGAAPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 36 - protein, 2593 aa, synthetic construct
  REGION 1..2593: note = Synthetic
GSPAGSPTSTEEGTSESATPESGPGTSTEPSEGSAPGSPAGSPTSTEEGTSTEPSEGSAPGTSTEPSEGSAPATSESATPESGPGSEPATSGSETPGSEPATSGSETPGSPAGSPTSTEEGTSESASPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASGRAANETPPGLTGAATSGSETPGTEIVLTQSPATLSLSPGERATLSCKASQDVSIGVAWYQQKPGQAPRLLIYSASYRYSGVPARFSGSGSGTDFTLTISSLEPEDFAVYYCQQYYIYPYTFGQGTKVEIKGATPPETGAETESPGETTGGSAESEPPGEGQVQLVQSGVEVKKPGASVKVSCKASGFTFTDYTMDWVRQAPGQGLEWMADVNPNSGGSIYNQRFKGRVTLTTDSSTTTAYMELKSLQFDDTAVYYCARNLGPSFYFDYWGQGTLVTVSSGGGSELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGASGRAANETPPGLTGASAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSTETPGSPAGSPTSTEEGTSESATPESGPGTSTEPSEGSAPGTSTEPSEGSAPGSPAGSPTSTEEGTSTEPSEGSAPGTATESPEGSAPGTSESATPESGPGTSTEPSEGSAPGTSAESATPESGPGSEPATSGSETPGTSTEPSEGSAPGTSTEPSEGSAPGTSESATPESGPGTESAS

SEQ ID NO: 37 - protein, 2881 aa, synthetic construct
  REGION 1..2881: note = Synthetic
SAGSPGSPAGSPTSTEEGTSESATPESGPGTSTEPSEGSAPGSPAGSPTSTEEGTSTEPSEGSAPGTSTEPSEGSAPGTSESATPESGPGSTPAESGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSTETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTESASESGRAANTGPPTLTAPATSGSETPGTDIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGSELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGESGRAANTGPPTLTAPSAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSTETPGSPAGSPTSTEEGTSESATPESGPGTSTEPSEGSAPGTSTEPSEGSAPGSPAGSPTSTEEGTSTEPSEGSAPGTATESPEGSAPGTSESATPESGPGTSTEPSEGSAPGTSAESATPESGPGSEPATSGSETPGTSTEPSEGSAPGTSTEPSEGSAPGTSESATPESGPGTESAS

SEQ ID NO: 38 - protein, 1446 aa, synthetic construct
  REGION 1..1446: note = Synthetic
ASSPAGSPTSTESGTSESATPESGPGTETEPSEGSAPGTSESATPESGPGSEPATSGSETPGTSESATPESGPGSTPAESGSETPGTSESATPESGPGTSTEPSEGSAPGSPAGSPTSTEEGTSESATPESGPGESPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPASGRGTNAGPAGLTGPATSGSETPGTEIVLTQSPATLSLSPGERATLSCKASQDVSIGVAWYQQKPGQAPRLLIYSASYRYSGVPARFSGSGSGTDFTLTISSLEPEDFAVYYCQQYYIYPYTFGQGTKVEIKGATPPETGAETESPGETTGGSAESEPPGEGQVQLVQSGVEVKKPGASVKVSCKASGFTFTDYTMDWVRQAPGQGLEWMADVNPNSGGSIYNQRFKGRVTLTTDSSTTTAYMELKSLQFDDTAVYYCARNLGPSFYFDYWGQGTLVTVSSGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGASGRGTNAGPAGLTGPEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESASPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESAT

SEQ ID NO: 39 - protein, 2024 aa, synthetic construct
  REGION 1..2024: note = Synthetic
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGEEPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGRSANHTPAGLTGPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGEAGRSANHTPAGLTGPSAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSTETPGSPAGSPTSTEEGTSESATPESGPGTSTEPSEGSAPGTSTEPSEGSAPGSPAGSPTSTEEGTSTEPSEGSAPGTATESPEGSAPGTSESATPESGPGTSTEPSEGSAPGTSAESATPESGPGSEPATSGSETPGTSTEPSEGSAPGTSTEPSEGSAPGTSESATPESGPGTESAS

SEQ ID NO: 40 - protein, 1744 aa, synthetic construct
  REGION 1..1744: note = Synthetic
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPASTRGENAGPAGLEAPATSGSETPGTDIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGSELVVTQEPSLTVSPGGTVTLTCRSSTGAVTTSNYANWVQQKPGQAPRGLIGGTNKRAPGTPARFSGSSLGGSAALTLSGVQPEDEAEYYCALWYSNLWVFGGGTKLTVLGATPPETGAETESPGETTGGSAESEPPGEGEVQLQESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGASTRGENAGPAGLEAPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGFTABTSESATPESGPGSEPATSGPTESGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 41 - protein, 2024 aa, synthetic construct
  REGION 1..2024: note = Synthetic
GSPAGSPTSTEEGTSESATPESGPGTSTEPSEGSAPGSPAGSPTSTEEGTSTEPSEGSAPGTSTEPSEGSAPGTSESATPESGPGSESATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPPTGRSGEGANATPSGLTGPATSGSETPGTEIVLTQSPATLSLSPGERATLSCKASQDVSIGVAWYQQKPGQAPRLLIYSASYRYSGVPARFSGSGSGTDFTLTISSLEPEDFAVYYCQQYYIYPYTFGQGTKVEIKGATPPETGAETESPGETTGGSAESEPPGEGQVQLVQSGVEVKKPGASVKVSCKASGFTFTDYTMDWVRQAPGQGLEWMADVNPNSGGSIYNQRFKGRVTLTTDSSTTTAYMELKSLQFDDTAVYYCARNLGPSFYFDYWGQGTLVTVSSGGGSELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGPTGRSGEGANATPSGLTGPPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPG

SEQ ID NO: 42 - protein, 1456 aa, synthetic construct
  REGION 1..1456: note = Synthetic
SPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPRTGRTGESANETPAGLGGPATSGSETPGTDIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGRTGRTGESANETPAGLGGPPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 43 - protein, 1743 aa, synthetic construct
  REGION 1..1743: note = Synthetic
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPTTARAGSAENLSPSGLTGPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGTTARAGSAENLSPSGLTGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPG

SEQ ID NO: 44 - protein, 1446 aa, synthetic construct
  REGION 1..1446: note = Synthetic
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGEEPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPLGGRADNHEPPELGAGATSGSETPGTDIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGSELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGLGGRADNHEPPELGAGTPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSESATSGSETPGSPAGSPTSTEEGTSTEPSEGSAPGTSTEPSEGSAPGSEPATSGSETPGTSESA

SEQ ID NO: 45 - protein, 1451 aa, synthetic construct
  REGION 1..1451: note = Synthetic
SPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPTTGRAGEAEGATSAGATGPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGSELVVTQEPSLTVSPGGTVTLTCRSSTGAVTTSNYANWVQQKPGQAPRGLIGGTNKRAPGTPARFSGSSLGGSAALTLSGVQPEDEAEYYCALWYSNLWVFGGGTKLTVLGATPPETGAETESPGETTGGSAESEPPGEGEVQLQESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGTTGRAGEAEGATSAGATGPEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESASPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESAT

SEQ ID NO: 46 - protein, 2609 aa, synthetic construct
  REGION 1..2609: note = Synthetic
SAGSPGSPAGSPTSTEEGTSESATPESGPGTSTEPSEGSAPGSPAGSPTSTEEGTSTEPSEGSAPGTSTEPSEGSAPGTSESATPESGPGSTPAESGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSTETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTESASTTGRAGEAANATSAGATGPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGTTGRAGEAANATSAGATGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGFTABTSESATPESGPGSEPATSGPTESGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 47 - protein, 1458 aa, synthetic construct
  REGION 1..1458: note = Synthetic
ASSPAGSPTSTESGTSESATPESGPGTETEPSEGSAPGTSESATPESGPGSEPATSGSETPGTSESATPESGPGSTPAESGSETPGTSESATPESGPGTSTEPSEGSAPGSPAGSPTSTEEGTSESATPESGPGESPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPTTGRATEAANATPAGLTGPATSGSETPGTEIVLTQSPATLSLSPGERATLSCKASQDVSIGVAWYQQKPGQAPRLLIYSASYRYSGVPARFSGSGSGTDFTLTISSLEPEDFAVYYCQQYYIYPYTFGQGTKVEIKGATPPETGAETESPGETTGGSAESEPPGEGQVQLVQSGVEVKKPGASVKVSCKASGFTFTDYTMDWVRQAPGQGLEWMADVNPNSGGSIYNQRFKGRVTLTTDSSTTTAYMELKSLQFDDTAVYYCARNLGPSFYFDYWGQGTLVTVSSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGTTGRATEAANATPAGLTGPPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 48 - protein, 6 aa, synthetic construct
  REGION 1..6: note = Synthetic
HHHHHH

SEQ ID NO: 49 - protein, 8 aa, synthetic construct
  REGION 1..8: note = Synthetic
HHHHHHHH

SEQ ID NO: 50 - protein, 11 aa, synthetic construct
  REGION 1..11: note = Synthetic
RASQDIRNYLN

SEQ ID NO: 51 - protein, 22 aa, synthetic construct
  REGION 1..22: note = Synthetic
ELVVTQEPSLTVSPGGTVTLTC

SEQ ID NO: 52 - protein, 15 aa, synthetic construct
  REGION 1..15: note = Synthetic
WVQQKPGQAPRGLIG

SEQ ID NO: 53 - protein, 32 aa, synthetic construct
  REGION 1..32: note = Synthetic
GTPARFSGSLLGGKAALTLSGVQPEDEAVYYC

SEQ ID NO: 54 - protein, 32 aa, synthetic construct
  REGION 1..32: note = Synthetic
GTPARFSGSSLGGKAALTLSGVQPEDEAVYYC

SEQ ID NO: 55 - protein, 32 aa, synthetic construct
  REGION 1..32: note = Synthetic
GTPARFSGSLLGGSAALTLSGVQPEDEAVYYC

SEQ ID NO: 56 - protein, 32 aa, synthetic construct
  REGION 1..32: note = Synthetic
GTPARFSGSSLGGSAALTLSGVQPEDEAVYYC

SEQ ID NO: 57 - protein, 32 aa, synthetic construct
  REGION 1..32: note = Synthetic
GTPARFSGSLLGGKAALTLSGVQPEDEAEYYC

SEQ ID NO: 58 - protein, 32 aa, synthetic construct
  REGION 1..32: note = Synthetic
GTPARFSGSSLGGSAALTLSGVQPEDEAEYYC

SEQ ID NO: 59 - protein, 9 aa, synthetic construct
  REGION 1..9: note = Synthetic
GGGTKLTVL

SEQ ID NO: 60 - protein, 25 aa, synthetic construct
  REGION 1..25: note = Synthetic
EVQLLESGGGIVQPGGSLKLSCAAS

SEQ ID NO: 61 - protein, 25 aa, synthetic construct
  REGION 1..25: note = Synthetic
EVQLQESGGGIVQPGGSLKLSCAAS

SEQ ID NO: 62 - protein, 25 aa, synthetic construct
  REGION 1..25: note = Synthetic
EVQLQESGGGLVQPGGSLKLSCAAS

SEQ ID NO: 63 - protein, 25 aa, synthetic construct
  REGION 1..25: note = Synthetic
EVQLLESGGGLVQPGGSLKLSCAAS

SEQ ID NO: 64 - protein, 14 aa, synthetic construct
  REGION 1..14: note = Synthetic
WVRQAPGKGLEWVA

SEQ ID NO: 65 - protein, 32 aa, synthetic construct
  REGION 1..32: note = Synthetic
RFTISRDDSKNTVYLQMNNLKTEDTAVYYCVR

SEQ ID NO: 66 - protein, 32 aa, synthetic construct
  REGION 1..32: note = Synthetic
RFTISRDDSKNTAYLQMNNLKTEDTAVYYCVR

SEQ ID NO: 67 - protein, 11 aa, synthetic construct
  REGION 1..11: note = Synthetic
WGQGTLVTVSS

SEQ ID NO: 68 - protein, 10 aa, synthetic construct
  REGION 1..10: note = Synthetic
SPATSGSTPE

SEQ ID NO: 69 - protein, 8 aa, synthetic construct
  REGION 1..8: note = Synthetic
GSAPATSE

SEQ ID NO: 70 - protein, 9 aa, synthetic construct
  REGION 1..9: note = Synthetic
GSAPGTATE

SEQ ID NO: 71 - protein, 7 aa, synthetic construct
  REGION 1..7: note = Synthetic
GSAPGTE

SEQ ID NO: 72 - protein, 8 aa, synthetic construct
  REGION 1..8: note = Synthetic
PATSGPTE

SEQ ID NO: 73 - protein, 5 aa, synthetic construct
  REGION 1..5: note = Synthetic
SASPE

SEQ ID NO: 74 - protein, 8 aa, synthetic construct
  REGION 1..8: note = Synthetic
PATSGSTE

SEQ ID NO: 75 - protein, 9 aa, synthetic construct
  REGION 1..9: note = Synthetic
GSAPGTSAE

SEQ ID NO: 76 - protein, 7 aa, synthetic construct
  REGION 1..7: note = Synthetic
SATSGSE

SEQ ID NO: 77 - protein, 9 aa, synthetic construct
  REGION 1..9: note = Synthetic
SGPGSTPAE

SEQ ID NO: 78 - protein, 16 aa, synthetic construct
  REGION 1..16: note = Synthetic
YTSRLESQQGNTLPWT

SEQ ID NO: 79 - protein, 10 aa, synthetic construct
  REGION 1..10: note = Synthetic
GYSFTGYTMN

SEQ ID NO: 80 - protein, 10 aa, synthetic construct
  REGION 1..10: note = Synthetic
LINPYKGVST

SEQ ID NO: 81 - protein, 13 aa, synthetic construct
  REGION 1..13: note = Synthetic
SGYYGDSDWYFDV

SEQ ID NO: 82 - protein, 30 aa, synthetic construct
  REGION 1..30: note = Synthetic
GSGEGSEGEGGGEGSEGEGSGEGGEGEGSG

SEQ ID NO: 83 - protein, 32 aa, synthetic construct
  REGION 1..32: note = Synthetic
TGSGEGSEGEGGGEGSEGEGSGEGGEGEGSGT

SEQ ID NO: 84 - protein, 30 aa, synthetic construct
  REGION 1..30: note = Synthetic
GATPPETGAETESPGETTGGSAESEPPGEG

SEQ ID NO: 85 - protein, 30 aa, synthetic construct
  REGION 1..30: note = Synthetic
GSAAPTAGTTPSASPAPPTGGSSAAGSPST

SEQ ID NO: 86 - protein, 6 aa, synthetic construct
  REGION 1..6: note = Synthetic
SGGGGS

SEQ ID NO: 87 - protein, 5 aa, synthetic construct
  REGION 1..5: note = Synthetic
GGGGS

SEQ ID NO: 88 - protein, 6 aa, synthetic construct
  REGION 1..6: note = Synthetic
GGSGGS

SEQ ID NO: 89 - protein, 5 aa, synthetic construct
  REGION 1..5: note = Synthetic
STEPS

SEQ ID NO: 90 - protein, 10 aa, synthetic construct
  REGION 1..10: note = Synthetic
SATPESGPGT

SEQ ID NO: 91 - protein, 10 aa, synthetic construct
  REGION 1..10: note = Synthetic
ATSGSETPGT

SEQ ID NO: 92 - protein, 10 aa, synthetic construct
  REGION 1..10: note = Synthetic
GTAEAASASG

SEQ ID NO: 93 - protein, 13 aa, synthetic construct
  REGION 1..13: note = Synthetic
STEPSEGSAPGTS

SEQ ID NO: 94 - protein, 6 aa, synthetic construct
  REGION 1..6: note = Synthetic
SGPGTS

SEQ ID NO: 95 - protein, 7 aa, synthetic construct
  REGION 1..7: note = Synthetic
GTSTEPS

SEQ ID NO: 96 - protein, 10 aa, synthetic construct
  REGION 1..10: note = Synthetic
TPGTSTEPSE

SEQ ID NO: 97 - protein, 14 aa, synthetic construct
  REGION 1..14: note = Synthetic
GSAPGSEPATSGSE

SEQ ID NO: 98 - protein, 864 aa, synthetic construct
  REGION 1..864: note = Synthetic
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 99 - protein, 288 aa, synthetic construct
  REGION 1..288: note = Synthetic
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 100 - protein, 23 aa, synthetic construct
  REGION 1..23: note = Synthetic
MKKNIAFLLASMFVFSIATNAYA

SEQ ID NO: 101 - protein, 109 aa, synthetic construct
  REGION 1..109: note = Synthetic
ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVL

SEQ ID NO: 102 - protein, 125 aa, synthetic construct
  REGION 1..125: note = Synthetic
EVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 103 - protein, 109 aa, synthetic construct
  REGION 1..109: note = Synthetic
ELVVTQEPSLTVSPGGTVTLTCRSSNGEVTTSNYANWVQQKPGQAPRGLIGGTIKRAPGTPARFSGSLLGGKAALTLSGVQPEDEAVYYCALWYPNLWVFGGGTKLTVL

SEQ ID NO: 104 - protein, 109 aa, synthetic construct
  REGION 1..109: note = Synthetic
ELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNLWVFGGGTKLTVL

SEQ ID NO: 105 - protein, 125 aa, synthetic construct
  REGION 1..125: note = Synthetic
EVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 106 - protein, 109 aa, synthetic construct
  REGION 1..109: note = Synthetic
ELVVTQEPSLTVSPGGTVTLTCRSSNGAVTSSNYANWVQQKPGQAPRGLIGGTNKRAPGTPARFSGSLLGGSAALTLSGVQPEDEAVYYCALWYPNLWVFGGGTKLTVL

SEQ ID NO: 107 - protein, 109 aa, synthetic construct
  REGION 1..109: note = Synthetic
ELVVTQEPSLTVSPGGTVTLTCRSSNGAVTSSNYANWVQQKPGQAPRGLIGGTNKRAPGTPARFSGSSLGGSAALTLSGVQPEDEAVYYCALWYPNLWVFGGGTKLTVL

SEQ ID NO: 108 - protein, 109 aa, synthetic construct
  REGION 1..109: note = Synthetic
ELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVL

SEQ ID NO: 109 - protein, 125 aa, synthetic construct
  REGION 1..125: note = Synthetic
EVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 110 - protein, 109 aa, synthetic construct
  REGION 1..109: note = Synthetic
ELVVTQEPSLTVSPGGTVTLTCRSSTGAVTTSNYANWVQQKPGQAPRGLIGGTNKRAPGTPARFSGSSLGGSAALTLSGVQPEDEAEYYCALWYSNLWVFGGGTKLTVL

SEQ ID NO: 111 - protein, 125 aa, synthetic construct
  REGION 1..125: note = Synthetic
EVQLQESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 112 - protein, 15 aa, synthetic construct
  REGION 1..15: note = Synthetic
GGGGSGGGGSGGGGS

SEQ ID NO: 113 - protein, 18 aa, synthetic construct
  REGION 1..18: note = Synthetic
GEGTSTGSGGSGGSGGAD

SEQ ID NO: 114 - protein, 18 aa, synthetic construct
  REGION 1..18: note = Synthetic
VEGGSGGSGGSGGSGGVD

SEQ ID NO: 115 - protein, 29 aa, synthetic construct
  REGION 1..29: note = Synthetic
RTSGPGDGGKGGPGKGPGGEGTKGTGPGG

SEQ ID NO: 116 - protein, 30 aa, synthetic construct; identical to SEQ ID NO: 82
  REGION 1..30: note = Synthetic

SEQ ID NO: 117 - protein, 32 aa, synthetic construct; identical to SEQ ID NO: 83
  REGION 1..32: note = Synthetic

SEQ ID NO: 118 - protein, 30 aa, synthetic construct; identical to SEQ ID NO: 84
  REGION 1..30: note = Synthetic

SEQ ID NO: 119 - protein, 30 aa, synthetic construct; identical to SEQ ID NO: 85
  REGION 1..30: note = Synthetic

SEQ ID NO: 120 - protein, 30 aa, synthetic construct
  REGION 1..30: note = Synthetic
GEGGESGGSEGEGSGEGEGGSGGEGESEGG

SEQ ID NO: 121 - protein, 30 aa, synthetic construct
  REGION 1..30: note = Synthetic
STETSPSTPTESPEAGSGSGSPESPSGTEA

SEQ ID NO: 122 - protein, 30 aa, synthetic construct
  REGION 1..30: note = Synthetic
PTGTTGEPSGEGSEPEGSAPTSSTSEATPS

SEQ ID NO: 123 - protein, 30 aa, synthetic construct
  REGION 1..30: note = Synthetic
SESESEGEAPTGPGASTTPEPSESPTPETS

SEQ ID NO: 124 - protein, 30 aa, synthetic construct
  REGION 1..30: note = Synthetic
PEGGESGEGTGPGTGGEPEGEGGPGGEGGT

SEQ ID NO: 125 - protein, 5 aa, synthetic construct
  REGION 1..5: note = Synthetic
SATPE

SEQ ID NO: 126 - protein, 13 aa, synthetic construct
  REGION 1..13: note = Synthetic
SGPGSEPATSGSE

SEQ ID NO: 127 - protein, 12 aa, synthetic construct
  REGION 1..12: note = Synthetic
GSAPGTSTEPSE

SEQ ID NO: 128 - protein, 6 aa, synthetic construct
  REGION 1..6: note = Synthetic
TPGTSE

SEQ ID NO: 129 - protein, 11 aa, synthetic construct
  REGION 1..11: note = Synthetic
SGPGTSTEPSE

SEQ ID NO: 130 - protein, 8 aa, synthetic construct
  REGION 1..8: note = Synthetic
GSAPGTSE

SEQ ID NO: 131 - protein, 8 aa, synthetic construct
  REGION 1..8: note = Synthetic
GTSTEPSE

SEQ ID NO: 132 - protein, 16 aa, synthetic construct
  REGION 1..16: note = Synthetic
GSAPGSPAGSPTSTEE

SEQ ID NO: 133 - protein, 12 aa, synthetic construct
  REGION 1..12: note = Synthetic
GSPAGSPTSTEE

SEQ ID NO: 134 - protein, 7 aa, synthetic construct
  REGION 1..7: note = Synthetic
SGPGTSE

SEQ ID NO: 135 - protein, 15 aa, synthetic construct
  REGION 1..15: note = Synthetic
SGPGSPAGSPTSTEE

SEQ ID NO: 136 - protein, 12 aa, synthetic construct
  REGION 1..12: note = Synthetic
TPGSEPATSGSE

SEQ ID NO: 137 - protein, 14 aa, synthetic construct
  REGION 1..14: note = Synthetic
TPGSPAGSPTSTEE

SEQ ID NO: 138 - protein, 14 aa, synthetic construct
  REGION 1..14: note = Synthetic
GSAPGSEPATSGSE

SEQ ID NO: 139 - protein, 10 aa, synthetic construct
  REGION 1..10: note = Synthetic
TPGTSTEPSE

SEQ ID NO: 140 - protein, 10 aa, synthetic construct
  REGION 1..10: note = Synthetic
SPATSGSTPE

SEQ ID NO: 141 - protein, 8 aa, synthetic construct
  REGION 1..8: note = Synthetic
GSAPATSE

SEQ ID NO: 142 - protein, 9 aa, synthetic construct
  REGION 1..9: note = Synthetic
GSAPGTATE

SEQ ID NO: 143 - protein, 7 aa, synthetic construct
  REGION 1..7: note = Synthetic
GSAPGTE

SEQ ID NO: 144 - protein, 8 aa, synthetic construct
  REGION 1..8: note = Synthetic
PATSGPTE

SEQ ID NO: 145 - protein, 5 aa, synthetic construct
  REGION 1..5: note = Synthetic
SASPE

SEQ ID NO: 146 - protein, 8 aa, synthetic construct
  REGION 1..8: note = Synthetic
PATSGSTE

SEQ ID NO: 147 - protein, 9 aa, synthetic construct
  REGION 1..9: note = Synthetic
GSAPGTSAE

SEQ ID NO: 148 - protein, 7 aa, synthetic construct
  REGION 1..7: note = Synthetic
SATSGSE

SEQ ID NO: 149 - protein, 9 aa, synthetic construct
  REGION 1..9: note = Synthetic
SGPGSTPAE

SEQ ID NO: 150 - protein, 13 aa, synthetic construct
  REGION 1..13: note = Synthetic
SGPGSTPAESGSE

SEQ ID NO: 151 - protein, 15 aa, synthetic construct
  REGION 1..15: note = Synthetic
SPAGSPTSTESGTSE

SEQ ID NO: 152-178 - skipped (27 entries)

SEQ ID NO: 179 - protein, 12 aa, synthetic construct
  REGION 1..12: note = Synthetic
GSETPSGPSETA

SEQ ID NO: 180 - protein, 12 aa, synthetic construct
  REGION 1..12: note = Synthetic
GPSETSTSEPGA

SEQ ID NO: 181 - protein, 12 aa, synthetic construct
  REGION 1..12: note = Synthetic
GSPSEPTEGTSA

SEQ ID NO: 182 - protein, 12 aa, synthetic construct
  REGION 1..12: note = Synthetic
GESPGGSSGSES

SEQ ID NO: 183 - protein, 12 aa, synthetic construct
  REGION 1..12: note = Synthetic
GSEGSSGPGESS

SEQ ID NO: 184 - protein, 12 aa, synthetic construct
  REGION 1..12: note = Synthetic
GSSESGSSEGGP

SEQ ID NO: 185 - protein, 12 aa, synthetic construct
  REGION 1..12: note = Synthetic
GSGGEPSESGSS

SEQ ID NO: 186 - protein, 12 aa, synthetic construct
  REGION 1..12: note = Synthetic
GSPAGSPTSTEE

SEQ ID NO: 187 - protein, 12 aa, synthetic construct
  REGION 1..12: note = Synthetic
GSEPATSGSETP

SEQ ID NO: 188 - protein, 12 aa, synthetic construct
  REGION 1..12: note = Synthetic
GTSESATPESGP

SEQ ID NO: 189 - protein, 12 aa, synthetic construct
  REGION 1..12: note = Synthetic
GTSTEPSEGSAP

SEQ ID NO: 190 - protein, 12 aa, synthetic construct
  REGION 1..12: note = Synthetic
GSTSESPSGTAP

SEQ ID NO: 191 - protein, 12 aa, synthetic construct
  REGION 1..12: note = Synthetic
GTSTPESGSASP

SEQ ID NO: 192 - protein, 12 aa, synthetic construct
  REGION 1..12: note = Synthetic
GTSPSGESSTAP

SEQ ID NO: 193 - protein, 12 aa, synthetic construct
  REGION 1..12: note = Synthetic
GSTSSTAESPGP

SEQ ID NO: 194 - protein, 12 aa, synthetic construct
  REGION 1..12: note = Synthetic
GTPGSGTASSSP

SEQ ID NO: 195 - protein, 12 aa, synthetic construct
  REGION 1..12: note = Synthetic
GSSTPSGATGSP

SEQ ID NO: 196 - protein, 12 aa, synthetic construct
  REGION 1..12: note = Synthetic
GSSPSASTGTGP

SEQ ID NO: 197 - protein, 12 aa, synthetic construct
  REGION 1..12: note = Synthetic
GASPGTSSTGSP

SEQ ID NO: 198 - protein, 12 aa, synthetic construct
  REGION 1..12: note = Synthetic
GEPAGSPTSTSE

SEQ ID NO: 199 - protein, 12 aa, synthetic construct
  REGION 1..12: note = Synthetic
GTGEPSSTPASE

SEQ ID NO: 200 - protein, 12 aa, synthetic construct
  REGION 1..12: note = Synthetic
GSGPSTESAPTE

SEQ ID NO: 201 - protein, 264 aa, synthetic construct
  REGION 1..264: note = Synthetic
ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 202 - protein, 264 aa, synthetic construct
  REGION 1..264: note = Synthetic
ELVVTQEPSLTVSPGGTVTLTCRSSNGEVTTSNYANWVQQKPGQAPRGLIGGTIKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 203 - protein, 264 aa, synthetic construct
  REGION 1..264: note = Synthetic
ELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 204 - protein, 264 aa, synthetic construct
  REGION 1..264: note = Synthetic
ELVVTQEPSLTVSPGGTVTLTCRSSNGAVTSSNYANWVQQKPGQAPRGLIGGTNKRAPGTPARFSGSLLGGSAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 205 - protein, 264 aa, synthetic construct
  REGION 1..264: note = Synthetic
ELVVTQEPSLTVSPGGTVTLTCRSSNGAVTSSNYANWVQQKPGQAPRGLIGGTNKRAPGTPARFSGSSLGGSAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 206 - protein, 264 aa, synthetic construct
  REGION 1..264: note = Synthetic
ELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 207 - protein, 264 aa, synthetic construct
  REGION 1..264: note = Synthetic
ELVVTQEPSLTVSPGGTVTLTCRSSTGAVTTSNYANWVQQKPGQAPRGLIGGTNKRAPGTPARFSGSSLGGSAALTLSGVQPEDEAEYYCALWYSNLWVFGGGTKLTVLGATPPETGAETESPGETTGGSAESEPPGEGEVQLQESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 208 - protein, 256 aa, synthetic construct
  REGION 1..256: note = Synthetic
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGLWVFGGGTKLTVLGATPPETGAETESPGETTGGSAESEPPGEGQVQLQQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 209 - protein, 255 aa, synthetic construct
  REGION 1..255: note = Synthetic
QAGLTQPPSASGTPGQRVTLSCSGSYSNIGTYYVYWYQQLPGTAPKLLIYSNDQRLSGVPDRFSGSKSGTSASLAISGLQSEDEAAYYCAAWDDSLNGWAFGGGTKLTVLGATPPETGAETESPGETTGGSAESEPPGEGQVQLQQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 210 - protein, 255 aa, synthetic construct
  REGION 1..255: note = Synthetic
QPGLTQPPSASGTPGQRVTLSCSGRSSNIGSYYVYWYQHLPGMAPKLLIYRNSRRPSGVPDRFSGSKSGTSASLVISGLQSDDEADYYCAAWDDSLKSWVFGGGTKLTVLGATPPETGAETESPGETTGGSAESEPPGEGQVQLQQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 211 - protein, 255 aa, synthetic construct
  REGION 1..255: note = Synthetic
QSVLTQPPSASGTPGQRVTISCSGSSSNIGTNYVYWYQQFPGTAPKLLIYSNNQRPSGVPDRFSGSKSGTSGSLAISGLQSEDEADYSCAAWDDSLNGWVFGGGTKLTVLGATPPETGAETESPGETTGGSAESEPPGEGQVQLVQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 212 - protein, 255 aa, synthetic construct
  REGION 1..255: note = Synthetic
QPGLTQPPSASGTPGQRVTISCSGSSSNIGSNYVYWYQQLPGTAPKLLIYRNNQRPSGVPDRLSGSKSGTSASLAISGLRSEDEADYYCAAWDDSLSGWVFGGGTKLTVLGATPPETGAETESPGETTGGSAESEPPGEGQVQLVQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 213 - protein, 256 aa, synthetic construct
  REGION 1..256: note = Synthetic
QAVLTQPPSASGTPGQRVTISCSGSSSNIGSYYVYWYQQVPGAAPKLLMRLNNQRPSGVPDRFSGAKSGTSASLVISGLRSEDEADYYCAAWDDSLSGQWVFGGGTKLTVLGATPPETGAETESPGETTGGSAESEPPGEGQVQLQQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 214 - protein, 255 aa, synthetic construct
  REGION 1..255: note = Synthetic
QAGLTQPPSASGTPGQRVTISCSGSSSNIGSNYVYWYQQLPGTAPKLLIYRNNQRPSGVPDRFSGSKSGTSASLAISGLRSEDEADYYCATWDASLSGWVFGGGTKLTVLGATPPETGAETESPGETTGGSAESEPPGEGEVQLVQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 215-221 - skipped (7 entries)

SEQ ID NO: 222 - protein, 8 aa, synthetic construct
  REGION 1..8: note = Synthetic
LTPRSLLV

SEQ ID NO: 223 - skipped

SEQ ID NO: 224 - protein, 8 aa, synthetic construct
  REGION 1..8: note = Synthetic
KLTRVVGG

SEQ ID NO: 225 - protein, 8 aa, synthetic construct
  REGION 1..8: note = Synthetic
TMTRIVGG

SEQ ID NO: 226 - protein, 8 aa, synthetic construct
  REGION 1..8: note = Synthetic
SPFRSTGG

SEQ ID NO: 227 - protein, 8 aa, synthetic construct
  REGION 1..8: note = Synthetic
LQVRIVGG

SEQ ID NO: 228 - protein, 8 aa, synthetic construct
  REGION 1..8: note = Synthetic
PLGRIVGG

SEQ ID NO: 229 - protein, 8 aa, synthetic construct
  REGION 1..8: note = Synthetic
IEGRTVGG

SEQ ID NO: 230 - protein, 8 aa, synthetic construct
  REGION 1..8: note = Synthetic
LTPRSLLV

SEQ ID NO: 231 - protein, 8 aa, synthetic construct
  REGION 1..8: note = Synthetic
LGPVSGVP

SEQ ID NO: 232 - protein, 8 aa, synthetic construct
  REGION 1..8: note = Synthetic
VAGDSLEE

SEQ ID NO: 233 - protein, 8 aa, synthetic construct
  REGION 1..8: note = Synthetic
GPAGLGGA

SEQ ID NO: 234 - protein, 8 aa, synthetic construct
  REGION 1..8: note = Synthetic
GPAGLRGA

SEQ ID NO: 235 - protein, 8 aa, synthetic construct
  REGION 1..8: note = Synthetic
APLGLRLR

SEQ ID NO: 236 - protein, 8 aa, synthetic construct
  REGION 1..8: note = Synthetic
PALPLVAQ

SEQ ID NO: 237 - protein, 7 aa, synthetic construct
  REGION 1..7: note = Synthetic
ENLYFQG

SEQ ID NO: 238 - protein, 8 aa, synthetic construct
  REGION 1..8: note = Synthetic
DDDKIVGG

SEQ ID NO: 239 - protein, 8 aa, synthetic construct
  REGION 1..8: note = Synthetic
LEVLFQGP

SEQ ID NO: 240 - protein, 8 aa, synthetic construct
  REGION 1..8: note = Synthetic
LPKTGSES

SEQ ID NO: 241 - protein, 8 aa, synthetic construct
  REGION 1..8: note = Synthetic
  SITE 2: note = MISC_FEATURE - X is P or A
  SITE 3: note = MISC_FEATURE - X is any amino acid
  SITE 6: note = MISC_FEATURE - X is any amino acid
  SITE 8: note = MISC_FEATURE - X is any amino acid
GXXGLXGX

SEQ ID NO: 242 - protein, 8 aa, synthetic construct
  REGION 1..8: note = Synthetic
  SITE 3: note = MISC_FEATURE - X is any amino acid
  SITE 6: note = MISC_FEATURE - X is any amino acid
  SITE 7: note = MISC_FEATURE - X is G or A
  SITE 8: note = MISC_FEATURE - X is any amino acid
GPXGLXXX

SEQ ID NO: 243 - protein, 7 aa, synthetic construct
  REGION 1..7: note = Synthetic
  SITE 7: note = MISC_FEATURE - X is G or S
ENLYFQX

SEQ ID NO: 244-245 - skipped (2 entries)

SEQ ID NO: 246 - protein, 8 aa, synthetic construct
  REGION 1..8: note = Synthetic
  SITE 3: note = MISC_FEATURE - X is K, E, A, or D
  SITE 6: note = MISC_FEATURE - X is any amino acid
  SITE 7: note = MISC_FEATURE - X is K, E, or S
LPXTGXXS

SEQ ID NO: 247-300 - skipped (54 entries)

SEQ ID NO: 301 - protein, 119 aa, synthetic construct [sequence omitted]

SEQ ID NO: 302 - protein, 122 aa, synthetic construct [sequence omitted]

SEQ ID NO: 303 - protein, 119 aa, synthetic construct
  REGION 1..119: note = Synthetic
QVQLVQSGGGVVQPGRSLRLSCKASGYTFTSYTMHWVRQAPGKGLEWIGYINPSSGYTKYNQKFKDRFTISADKSKSTAFLQMDSLRPEDTGVYFCARWQDYDVYFDYWGQGTPVTVSS

SEQ ID NO: 304 - protein, 119 aa, synthetic construct [sequence omitted]

SEQ ID NO: 305 - protein, 119 aa, synthetic construct
  REGION 1..119: note = Synthetic
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 306 - protein, 119 aa, synthetic construct
  REGION 1..119: note = Synthetic
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 307 - protein, 125 aa, synthetic construct
  REGION 1..125: note = Synthetic
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 308 - protein, 125 aa, synthetic construct
  REGION 1..125: note = Synthetic
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 309 - protein, 125 aa, synthetic construct; identical to SEQ ID NO: 109
  REGION 1..125: note = Synthetic

SEQ ID NO: 310 - protein, 125 aa, synthetic construct
  REGION 1..125: note = Synthetic
EVKLLESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSS

SEQ ID NO: 311-350 - skipped (40 entries)

SEQ ID NO: 351 - protein, 107 aa, synthetic construct
  REGION 1..107: note = Synthetic
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITR

SEQ ID NO: 352 - protein, 107 aa, synthetic construct [sequence omitted]

SEQ ID NO: 353 - protein, 107 aa, synthetic construct
  REGION 1..107: note = Synthetic
DIQMTQSPSSLSASVGDRVTMTCRASSSVSYMHWYQQTPGKAPKPWIYATSNLASGVPSRFSGSGSGTDYTLTISSLQPEDIATYYCQQWSSNPPTFGQGTKLQITR

SEQ ID NO: 354 - protein, 107 aa, synthetic construct
  REGION 1..107: note = Synthetic
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 355 - protein, 106 aa, synthetic construct
  REGION 1..106: note = Synthetic
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 356 - protein, 106 aa, synthetic construct
  REGION 1..106: note = Synthetic
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 357 - protein, 109 aa, synthetic construct
  REGION 1..109: note = Synthetic
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 358 - protein, 109 aa, synthetic construct
  REGION 1..109: note = Synthetic
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 359 - protein, 109 aa, synthetic construct; identical to SEQ ID NO: 108
  REGION 1..109: note = Synthetic

SEQ ID NO: 360 - protein, 109 aa, synthetic construct
  REGION 1..109: note = Synthetic
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 361-600 - skipped (240 entries)

SEQ ID NO: 601 - protein, 144 aa, synthetic construct
  REGION 1..144: note = Synthetic
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 602 - protein, 144 aa, synthetic construct
  REGION 1..144: note = Synthetic
SPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPG

SEQ ID NO: 603 - protein, 144 aa, synthetic construct
  REGION 1..144: note = Synthetic
TSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPG

SEQ ID NO: 604 - protein, 144 aa, synthetic construct; identical to SEQ ID NO: 603
  REGION 1..144: note = Synthetic

SEQ ID NO: 605 - protein, 144 aa, synthetic construct
  REGION 1..144: note = Synthetic
SPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPG

SEQ ID NO: 606 - protein, 144 aa, synthetic construct; identical to SEQ ID NO: 605
  REGION 1..144: note = Synthetic

SEQ ID NO: 607 - protein, 144 aa, synthetic construct
  REGION 1..144: note = Synthetic
TSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 608 - protein, 144 aa, synthetic construct; identical to SEQ ID NO: 607
  REGION 1..144: note = Synthetic

SEQ ID NO: 609 - protein, 144 aa, synthetic construct
  REGION 1..144: note = Synthetic
TSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEG

SEQ ID NO: 610 - protein, 144 aa, synthetic construct
  REGION 1..144: note = Synthetic
TSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 611 - protein, 288 aa, synthetic construct; identical to SEQ ID NO: 99
  REGION 1..288: note = Synthetic

SEQ ID NO: 612 - protein, 288 aa, synthetic construct
  REGION 1..288: note = Synthetic
GSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 613 - protein, 576 aa, synthetic construct
  REGION 1..576: note = Synthetic
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 614 - protein, 625 aa, synthetic construct
  REGION 1..625: note = Synthetic
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 615 - protein, 864 aa, synthetic construct; identical to SEQ ID NO: 98
  REGION 1..864: note = Synthetic

SEQ ID NO: 616 - protein, 865 aa, synthetic construct
  REGION 1..865: note = Synthetic
GGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 617 - protein, 866 aa, synthetic construct
  REGION 1..866: note = Synthetic
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 618 - protein, 1152 aa, synthetic construct
  REGION 1..1152: note = Synthetic
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 619 - protein, 144 aa, synthetic construct
  REGION 1..144: note = Synthetic
STEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGS

SEQ ID NO: 620 - protein, 144 aa, synthetic construct
  REGION 1..144: note = Synthetic
SEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPG

SEQ ID NO: 621 - protein, 180 aa, synthetic construct
  REGION 1..180: note = Synthetic
TSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 622 - protein, 216 aa, synthetic construct
  REGION 1..216: note = Synthetic
PESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 623 - protein, 252 aa, synthetic construct
  REGION 1..252: note = Synthetic
ESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSE

SEQ ID NO: 624 - protein, 288 aa, synthetic construct
  REGION 1..288: note = Synthetic
TPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 625 - protein, 324 aa, synthetic construct
  REGION 1..324: note = Synthetic
PESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 626 - protein, 360 aa, synthetic construct
  REGION 1..360: note = Synthetic
PESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 627 - protein, 360 aa, synthetic construct
  REGION 1..360: note = Synthetic
PESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPS

SEQ ID NO: 628 - protein, 432 aa, synthetic construct
  REGION 1..432: note = Synthetic
EGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 629 - protein, 468 aa, synthetic construct
  REGION 1..468: note = Synthetic
EGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 630 - protein, 504 aa, synthetic construct
  REGION 1..504: note = Synthetic
EGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 631 - protein, 540 aa, synthetic construct
  REGION 1..540: note = Synthetic
TPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEP

SEQ ID NO: 632 - protein, 576 aa, synthetic construct
  REGION 1..576: note = Synthetic
TPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 633 - protein, 612 aa, synthetic construct
  REGION 1..612: note = Synthetic
GSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 634 - protein, 648 aa, synthetic construct
  REGION 1..648: note = Synthetic
PESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 635 - protein, 684 aa, synthetic construct
  REGION 1..684: note = Synthetic
EGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 636 - protein, 720 aa, synthetic construct
  REGION 1..720: note = Synthetic
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTE

SEQ ID NO: 637 - protein, 756 aa, synthetic construct
  REGION 1..756: note = Synthetic
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSES

SEQ ID NO: 638 - protein, 792 aa, synthetic construct
  REGION 1..792: note = Synthetic
EGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 639 - protein, 828 aa, synthetic construct
  REGION 1..828: note = Synthetic
PESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 640 - protein, 869 aa, synthetic construct
  REGION 1..869: note = Synthetic
GSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGR

SEQ ID NO: 641 - protein, 144 aa, synthetic construct
  REGION 1..144: note = Synthetic
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTESASR

SEQ ID NO: 642 - protein, 288 aa, synthetic construct
  REGION 1..288: note = Synthetic
SAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASR

SEQ ID NO: 643 - protein, 432 aa, synthetic construct
  REGION 1..432: note = Synthetic
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTESASR

SEQ ID NO: 644 - protein, 576 aa, synthetic construct
  REGION 1..576: note = Synthetic
SAGSPTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASR

SEQ ID NO: 645 - protein, 864 aa, synthetic construct
  REGION 1..864: note = Synthetic
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTESASR

SEQ ID NO: 646 - protein, 712 aa, synthetic construct
  REGION 1..712: note = Synthetic
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEAHHH

SEQ ID NO: 647 - protein, 864 aa, synthetic construct
  REGION 1..864: note = Synthetic
GSPGAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTESASR

SEQ ID NO: 648 - protein, 288 aa, synthetic construct
  REGION 1..288: note = Synthetic
SPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPG

SEQ ID NO: 649 - protein, 284 aa, synthetic construct
  REGION 1..284: note = Synthetic
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSE

SEQ ID NO: 650 - protein, 292 aa, synthetic construct
  REGION 1..292: note = Synthetic
SPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 651 - protein, 864 aa, synthetic construct
  REGION 1..864: note = Synthetic
AGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 652 - protein, 867 aa, synthetic construct
  REGION 1..867: note = Synthetic
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 653 - protein, 867 aa, synthetic construct
  REGION 1..867: note = Synthetic
SPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 654 - protein, 868 aa, synthetic construct
  REGION 1..868: note = Synthetic
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 655 - protein, 144 aa, synthetic construct
  REGION 1..144: note = Synthetic
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAP

SEQ ID NO: 656 - protein, 292 aa, synthetic construct; identical to SEQ ID NO: 650
  REGION 1..292: note = Synthetic

SEQ ID NO: 657 - protein, 293 aa, synthetic construct
  REGION 1..293: note = Synthetic
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPEGAAEPEA

SEQ ID NO: 658 - protein, 300 aa, synthetic construct
  REGION 1..300: note = Synthetic
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGAAEPEA

SEQ ID NO: 659 - protein, 584 aa, synthetic construct
  REGION 1..584: note = Synthetic
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGAAEPEA

SEQ ID NO: 660-675 - skipped (16 entries)

SEQ ID NO: 676 - protein, 144 aa, synthetic construct; identical to SEQ ID NO: 601
  REGION 1..144: note = Synthetic

SEQ ID NO: 677 - protein, 288 aa, synthetic construct; identical to SEQ ID NO: 99
  REGION 1..288: note = Synthetic

SEQ ID NO: 678 - protein, 576 aa, synthetic construct; identical to SEQ ID NO: 613
  REGION 1..576: note = Synthetic

SEQ ID NO: 679 - protein, 864 aa, synthetic construct; identical to SEQ ID NO: 98
  REGION 1..864: note = Synthetic

SEQ ID NO: 680-777 - skipped (98 entries)

SEQ ID NO: 778 - protein, 119 aa, synthetic construct
  REGION 1..119: note = Synthetic
QVQLVESGGGLVQPGGSLRLSCAASGFTFSSYAMGWVRQAPGKGLEWVSSISGSSRYIYYADSVKGRFTISRDNSKNTLYLQMNSLRAEDTAVYYCAKMDASGSYFNFWGQGTLVTVSS

SEQ ID NO: 779 - protein, 115 aa, synthetic construct
  REGION 1..115: note = Synthetic
QVQLLQSAAEVKKPGESLKISCKGSGYSFTSYWIGWVRQMPGKGLEWMGIIYPGDSDTRYSPSFQGQVTISADKSISTAYLQWSSLKASDTAVYYCARWRDSPLWGQGTLVTVSS

SEQ ID NO: 780 - protein, 120 aa, synthetic construct [sequence omitted]

SEQ ID NO: 781 - protein, 120 aa, synthetic construct
  REGION 1..120: note = Synthetic
QVQLQQSGPELVKPGASLKLSCTASGFNIKDTYIHWVKQRPEQGLEWIGRIYPTNGYTRYDPKFQDKATITADTSSNTAYLQVSRLTSEDTAVYYCSRWGGDGFYAMDYWGQGASVTVSS

SEQ ID NO: 782 - protein, 119 aa, synthetic construct
  REGION 1..119: note = Synthetic
QVQLVESGGGLVQPGGSLRLSCAASGFTFRSYAMSWVRQAPGKGLEWVSAISGRGDNTYYADSVKGRFTISRDNSKNTLYLQMNSLRAEDTAVYYCAKMTSNAFAFDYWGQGTLVTVSS

SEQ ID NO: 783 - protein, 119 aa, synthetic construct [sequence omitted]

SEQ ID NO: 784-877 - skipped (94 entries)

SEQ ID NO: 878 - protein, 102 aa, synthetic construct
  REGION 1..102: note = Synthetic
QSPSFLSAFVGDRITITCRASPGIRNYLAWYQQKPGKAPKLLIYAASTLQSGVPSRFSGSGSGTDFTLTISSLQPEDFATYYCQQYNSYPLSFGGGTKVEIK

SEQ ID NO: 879 - protein, 110 aa, synthetic construct
  REGION 1..110: note = Synthetic
QAVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGQYVFGGGTKLTVL

SEQ ID NO: 880 - protein, 107 aa, synthetic construct [sequence omitted]

SEQ ID NO: 881 - protein, 107 aa, synthetic construct
  REGION 1..107: note = Synthetic
DIVMTQSHKFMSTSVGDRVSITCKASQDVNTAVAWYQQKPGHSPKLLIYSASFRYTGVPDRFTGSRSGTDFTFTISSVQAEDLAVYYCQQHYTTPPTFGGGTKVEIK

SEQ ID NO: 882 - protein, 111 aa, synthetic construct
  REGION 1..111: note = Synthetic
QSVLTQPPSVSGAPGQRVTISCTGSSSNIGAGYGVHWYQQLPGTAPKLLIYGNTNRPSGVPDRFSGFKSGTSASLAITGLQAEDEADYYCQFYDSSLSGWVFGGGTKLTVL

SEQ ID NO: 883 - protein, 107 aa, synthetic construct [sequence omitted]

SEQ ID NO: 884-1714 - skipped (831 entries)

SEQ ID NO: 1715 - protein, 12 aa, synthetic construct
  REGION 1..12: note = Synthetic
GSGASEPTSTEP

SEQ ID NO: 1716 - protein, 12 aa, synthetic construct
  REGION 1..12: note = Synthetic
GSEPATSGTEPS

SEQ ID NO: 1717 - protein, 12 aa, synthetic construct
  REGION 1..12: note = Synthetic
GTSEPSTSEPGA

SEQ ID NO: 1718 - protein, 12 aa, synthetic construct
  REGION 1..12: note = Synthetic
GTSTEPSEPGSA

SEQ ID NO: 1719 - protein, 12 aa, synthetic construct
  REGION 1..12: note = Synthetic
GSTAGSETSTEA

SEQ ID NO: 1720 - protein, 12 aa, synthetic construct
  REGION 1..12: note = Synthetic
GSETATSGSETA

SEQ ID NO: 1721 - protein, 12 aa, synthetic construct
  REGION 1..12: note = Synthetic
GTSESATSESGA

SEQ ID NO: 1722 - protein, 12 aa, synthetic construct
  REGION 1..12: note = Synthetic
GTSTEASEGSAS

SEQ ID NO: 1723-7000 - skipped (5278 entries)

SEQ ID NO: 7001 - protein, 16 aa, synthetic construct
  REGION 1..16: note = Synthetic
EAGRSANHEPLGLVAT

SEQ ID NO: 7002 - protein, 16 aa, synthetic construct
  REGION 1..16: note = Synthetic
ASGRSTNAGPSGLAGP

SEQ ID NO: 7003 - protein, 16 aa, synthetic construct
  REGION 1..16: note = Synthetic
ASGRSTNAGPQGLAGQ

SEQ ID NO: 7004 - protein, 16 aa, synthetic construct
  REGION 1..16: note = Synthetic
ASGRSTNAGPPGLTGP

SEQ ID NO: 7005 - protein, 16 aa, synthetic construct
  REGION 1..16: note = Synthetic
ASSRGTNAGPAGLTGP

SEQ ID NO: 7006 - protein, 16 aa, synthetic construct
  REGION 1..16: note = Synthetic
ASSRTTNTGPSTLTGP

SEQ ID NO: 7007 - protein, 16 aa, synthetic construct
  REGION 1..16: note = Synthetic
AAGRSDNGTPLELVAP

SEQ ID NO: 7008 - protein, 16 aa, synthetic construct
  REGION 1..16: note = Synthetic
EAGRSANHEPLGLVAT

SEQ ID NO: 7009 - protein, 16 aa, synthetic construct
  REGION 1..16: note = Synthetic
ASGRGTNAGPAGLTGP

SEQ ID NO: 7010 - protein, 16 aa, synthetic construct
  REGION 1..16: note = Synthetic
LFGRNDNHEPLELGGG

SEQ ID NO: 7011 - protein, 16 aa, synthetic construct
  REGION 1..16: note = Synthetic
TAGRSDNLEPLGLVFG

SEQ ID NO: 7012 - protein, 16 aa, synthetic construct
  REGION 1..16: note = Synthetic
LDGRSDNFHPPELVAG

SEQ ID NO: 7013 - protein, 16 aa, synthetic construct
  REGION 1..16: note = Synthetic
LEGRSDNEEPENLVAG

SEQ ID NO: 7014 - protein, 16 aa, synthetic construct
  REGION 1..16: note = Synthetic
LKGRSDNNAPLALVAG

SEQ ID NO: 7015 - protein, 16 aa, synthetic construct
  REGION 1..16: note = Synthetic
VYSRGTNAGPHGLTGR

SEQ ID NO: 7016 - protein, 16 aa, synthetic construct
  REGION 1..16: note = Synthetic
ANSRGTNKGFAGLIGP

SEQ ID NO: 7017 - protein, 16 aa, synthetic construct
  REGION 1..16: note = Synthetic
ASSRLTNEAPAGLTIP

SEQ ID NO: 7018 - protein, 16 aa, synthetic construct
  REGION 1..16: note = Synthetic
DQSRGTNAGPEGLTDP

SEQ ID NO: 7019 - protein, 16 aa, synthetic construct
  REGION 1..16: note = Synthetic
ESSRGTNIGQGGLTGP

SEQ ID NO: 7020 - protein, 16 aa, synthetic construct
  REGION 1..16: note = Synthetic
SSSRGTNQDPAGLTIP

SEQ ID NO: 7021 - protein, 16 aa, synthetic construct
  REGION 1..16: note = Synthetic
ASSRGQNHSPMGLTGP

SEQ ID NO: 7022 - protein, 16 aa, synthetic construct
  REGION 1..16: note = Synthetic
AYSRGPNAGPAGLEGR

SEQ ID NO: 7023 - protein, 16 aa, synthetic construct
  REGION 1..16: note = Synthetic
ASERGNNAGPANLTGF

SEQ ID NO: 7024 - protein, 16 aa, synthetic construct
  REGION 1..16: note = Synthetic
ASHRGTNPKPAILTGP

SEQ ID NO: 7025 - protein, 16 aa, synthetic construct
  REGION 1..16: note = Synthetic
MSSRRTNANPAQLTGP

SEQ ID NO: 7026 - protein, 16 aa, synthetic construct
  REGION 1..16: note = Synthetic
GAGRTDNHEPLELGAA

SEQ ID NO: 7027 - protein, 16 aa, synthetic construct
  REGION 1..16: note = Synthetic
LAGRSENTAPLELTAG

SEQ ID NO: 7028 - protein, 16 aa, synthetic construct
  REGION 1..16: note = Synthetic
LEGRPDNHEPLALVAS

SEQ ID NO: 7029 - protein, 16 aa, synthetic construct
  REGION 1..16: note = Synthetic
LSGRSDNEEPLALPAG

SEQ ID NO: 7030 - protein, 16 aa, synthetic construct
  REGION 1..16: note = Synthetic
EAGRTDNHEPLELSAP

SEQ ID NO: 7031 - protein, 16 aa, synthetic construct
  REGION 1..16: note = Synthetic
EGGRSDNHGPLELVSG

SEQ ID NO: 7032 - protein, 16 aa, synthetic construct
  REGION 1..16: note = Synthetic
LSGRSDNEAPLELEAG

SEQ ID NO: 7033 - protein, 16 aa, synthetic construct
  REGION 1..16: note = Synthetic
LGGRADNHEPPELGAG

SEQ ID NO: 7034 - protein, 16 aa, synthetic construct
  REGION 1..16: note = Synthetic
PPSRGTNAEPAGLTGE

SEQ ID NO: 7035 - protein, 16 aa, synthetic construct
  REGION 1..16: note = Synthetic
ASTRGENAGPAGLEAP

SEQ ID NO: 7036 - protein, 16 aa, synthetic construct
  REGION 1..16: note = Synthetic
ESSRGTNGAPEGLTGP

SEQ ID NO: 7037 - protein, 16 aa, synthetic construct
  REGION 1..16: note = Synthetic
ASSRATNESPAGLTGE

SEQ ID NO: 7038 - protein, 16 aa, synthetic construct
  REGION 1..16: note = Synthetic
ASSRGENPPPGGLTGP

SEQ ID NO: 7039 - protein, 16 aa, synthetic construct
  REGION 1..16: note = Synthetic
AASRGTNTGPAELTGS

SEQ ID NO: 7040 - protein, 16 aa, synthetic construct
  REGION 1..16: note = Synthetic
AGSRTTNAGPGGLEGP

SEQ ID NO: 7041 - protein, 16 aa, synthetic construct
  REGION 1..16: note = Synthetic
APSRGENAGPATLTGA

SEQ ID NO: 7042 - protein, 16 aa, synthetic construct
  REGION 1..16: note = Synthetic
ESGRAANTGPPTLTAP

SEQ ID NO: 7043 - protein, 16 aa, synthetic construct
  REGION 1..16: note = Synthetic
NPGRAANEGPPGLPGS

SEQ ID NO: 7044 - protein, 16 aa, synthetic construct
  REGION 1..16: note = Synthetic
ESSRAANLTPPELTGP

SEQ ID NO: 7045 - protein, 16 aa, synthetic construct
  REGION 1..16: note = Synthetic
ASGRAANETPPGLTGA

SEQ ID NO: 7046 - protein, 16 aa, synthetic construct
  REGION 1..16: note = Synthetic
NSGRGENLGAPGLTGT

SEQ ID NO: 7047 - protein, 16 aa, synthetic construct
  REGION 1..16: note = Synthetic
TTGRAANLTPAGLTGP

SEQ ID NO: 7048 - protein, 16 aa, synthetic construct
  REGION 1..16: note = Synthetic
EAGRSANHTPAGLTGP

SEQ ID NO: 7049 - protein, 16 aa, synthetic construct
  REGION 1..16: note = Synthetic
ESGRAANTTPAGLTGP

SEQ ID NO: 7050 - protein, 19 aa, synthetic construct
  REGION 1..19: note = Synthetic
TTGRATEAANLTPAGLTGP

SEQ ID NO: 7051 - protein, 19 aa, synthetic construct
  REGION 1..19: note = Synthetic
TTGRAEEAANLTPAGLTGP

SEQ ID NO: 7052 - protein, 19 aa, synthetic construct
  REGION 1..19: note = Synthetic
TTGRAGEAANLTPAGLTGP

SEQ ID NO: 7053 - protein, 19 aa, synthetic construct
  REGION 1..19: note = Synthetic
TTGRATEAANATPAGLTGP

SEQ ID NO: 7054 - protein, 19 aa, synthetic construct
  REGION 1..19: note = Synthetic
TTGRAGEAEGATSAGATGP

SEQ ID NO: 7055 - protein, 19 aa, synthetic construct
  REGION 1..19: note = Synthetic
TTGEAGEAANATSAGATGP

SEQ ID NO: 7056 - protein, 19 aa, synthetic construct
  REGION 1..19: note = Synthetic
TTGEAGEAAGLTPAGLTGP

SEQ ID NO: 7057 - protein, 19 aa, synthetic construct
  REGION 1..19: note = Synthetic
TTGAAGEAANATPAGLTGP

SEQ ID NO: 7058 - protein, 19 aa, synthetic construct
  REGION 1..19: note = Synthetic
TTGRAGEAAGLTPAGLTGP

SEQ ID NO: 7059 - protein, 19 aa, synthetic construct
  REGION 1..19: note = Synthetic
TTGRAGEAANATSAGATGP

SEQ ID NO: 7060 - protein, 19 aa, synthetic construct
  REGION 1..19: note = Synthetic
TTGEAGEAAGATSAGATGP

SEQ ID NO: 7061 - protein, 16 aa, synthetic construct
  REGION 1..16: note = Synthetic
ESGRAANTEPPELGAG

SEQ ID NO: 7062 - protein, 16 aa, synthetic construct
  REGION 1..16: note = Synthetic
ESGRAANTAPEGLTGP

SEQ ID NO: 7063 - protein, 16 aa, synthetic construct
  REGION 1..16: note = Synthetic
EPGRAANHEPSGLTEG

SEQ ID NO: 7064 - protein, 19 aa, synthetic construct
  REGION 1..19: note = Synthetic
ESGRAANHTGAPPGGLTGP

SEQ ID NO: 7065 - protein, 19 aa, synthetic construct
  REGION 1..19: note = Synthetic
TTGRTGEGANATPGGLTGP

SEQ ID NO: 7066 - protein, 19 aa, synthetic construct
  REGION 1..19: note = Synthetic
RTGRSGEAANETPEGLEGP

SEQ ID NO: 7067 - protein, 19 aa, synthetic construct
  REGION 1..19: note = Synthetic
RTGRTGESANETPAGLGGP

SEQ ID NO: 7068 - protein, 19 aa, synthetic construct
  REGION 1..19: note = Synthetic
STGRTGEPANETPAGLSGP

SEQ ID NO: 7069 - protein, 19 aa, synthetic construct
  REGION 1..19: note = Synthetic
TTGRAGEPANATPTGLSGP

SEQ ID NO: 7070 - protein, 19 aa, synthetic construct
  REGION 1..19: note = Synthetic
RTGRPGEGANATPTGLPGP

SEQ ID NO: 7071 - protein, 19 aa, synthetic construct
  REGION 1..19: note = Synthetic
RTGRGGEAANATPSGLGGP

SEQ ID NO: 7072 - protein, 19 aa, synthetic construct
  REGION 1..19: note = Synthetic
STGRSGESANATPGGLGGP

SEQ ID NO: 7073 - protein, 19 aa, synthetic construct
  REGION 1..19: note = Synthetic
RTGRTGEEANATPAGLPGP

SEQ ID NO: 7074 - protein, 19 aa, synthetic construct
  REGION 1..19: note = Synthetic
ATGRPGEPANTTPEGLEGP

SEQ ID NO: 7075 - protein, 19 aa, synthetic construct
  REGION 1..19: note = Synthetic
STGRSGEPANATPGGLTGP

SEQ ID NO: 7076 - protein, 19 aa, synthetic construct
  REGION 1..19: note = Synthetic
PTGRGGEGANTTPTGLPGP

SEQ ID NO: 7077 - protein, 19 aa, synthetic construct
  REGION 1..19: note = Synthetic
PTGRSGEGANATPSGLTGP

SEQ ID NO: 7078 - protein, 19 aa, synthetic construct
  REGION 1..19: note = Synthetic
TTGRASEGANSTPAPLTEP

SEQ ID NO: 7079 - protein, 19 aa, synthetic construct
  REGION 1..19: note = Synthetic
TYGRAAEAANTTPAGLTAP

SEQ ID NO: 7080 - protein, 19 aa, synthetic construct
  REGION 1..19: note = Synthetic
TTGRATEGANATPAELTEP

SEQ ID NO: 7081 - protein, 19 aa, synthetic construct
  REGION 1..19: note = Synthetic
TVGRASEEANTTPASLTGP

SEQ ID NO: 7082 - protein, 19 aa, synthetic construct
  REGION 1..19: note = Synthetic
TTGRAPEAANATPAPLTGP

SEQ ID NO: 7083 - protein, 19 aa, synthetic construct
  REGION 1..19: note = Synthetic
TWGRATEPANATPAPLTSP

SEQ ID NO: 7084 - protein, 19 aa, synthetic construct
  REGION 1..19: note = Synthetic
TVGRASESANATPAELTSP

SEQ ID NO: 7085 - protein, 19 aa, synthetic construct
  REGION 1..19: note = Synthetic
TVGRAPEGANSTPAGLTGP

SEQ ID NO: 7086 - protein, 19 aa, synthetic construct
  REGION 1..19: note = Synthetic
TWGRATEAPNLEPATLTTP

SEQ ID NO: 7087 - protein, 19 aa, synthetic construct
  REGION 1..19: note = Synthetic
TTGRATEAPNLTPAPLTEP

SEQ ID NO: 7088 - protein, 19 aa, synthetic construct
  REGION 1..19: note = Synthetic
TQGRATEAPNLSPAALTSP

SEQ ID NO: 7089 - protein, 19 aa, synthetic construct
  REGION 1..19: note = Synthetic
TQGRAAEAPNLTPATLTAP

SEQ ID NO: 7090 - protein, 19 aa, synthetic construct
  REGION 1..19: note = Synthetic
TSGRAPEATNLAPAPLTGP

SEQ ID NO: 7091 - protein, 19 aa, synthetic construct
  REGION 1..19: note = Synthetic
TQGRAAEAANLTPAGLTEP

SEQ ID NO: 7092 - protein, 19 aa, synthetic construct
  REGION 1..19: note = Synthetic
TTGRAGSAPNLPPTGLTTP

SEQ ID NO: 7093 - protein, 19 aa, synthetic construct
  REGION 1..19: note = Synthetic
TTGRAGGAENLPPEGLTAP

SEQ ID NO: 7094 - protein, 19 aa, synthetic construct
  REGION 1..19: note = Synthetic
TTSRAGTATNLTPEGLTAP

SEQ ID NO: 7095 - protein, 19 aa, synthetic construct
  REGION 1..19: note = Synthetic
TTGRAGTATNLPPSGLTTP

SEQ ID NO: 7096 - protein, 19 aa, synthetic construct
  REGION 1..19: note = Synthetic
TTARAGEAENLSPSGLTAP

SEQ ID NO: 7097 - protein, 19 aa, synthetic construct
  REGION 1..19: note = Synthetic
TTGRAGGAGNLAPGGLTEP

SEQ ID NO: 7098 - protein, 19 aa, synthetic construct
  REGION 1..19: note = Synthetic
TTGRAGTATNLPPEGLTGP

SEQ ID NO: 7099 - protein, 19 aa, synthetic construct
  REGION 1..19: note = Synthetic
TTGRAGGAANLAPTGLTEP

SEQ ID NO: 7100 - protein, 19 aa, synthetic construct
  REGION 1..19: note = Synthetic
TTGRAGTAENLAPSGLTTP

SEQ ID NO: 7101 - protein, 19 aa, synthetic construct
  REGION 1..19: note = Synthetic
TTGRAGSATNLGPGGLTGP

SEQ ID NO: 7102 - protein, 19 aa, synthetic construct
  REGION 1..19: note = Synthetic
TTARAGGAENLTPAGLTEP

SEQ ID NO: 7103 - protein, 19 aa, synthetic construct
  REGION 1..19: note = Synthetic
TTARAGSAENLSPSGLTGP

SEQ ID NO: 7104 - protein, 19 aa, synthetic construct
  REGION 1..19: note = Synthetic
TTARAGGAGNLAPEGLTTP

SEQ ID NO: 7105 - protein, 19 aa, synthetic construct
  REGION 1..19: note = Synthetic
TTSRAGAAENLTPTGLTGP

SEQ ID NO: 7106 - protein, 19 aa, synthetic construct
  REGION 1..19: note = Synthetic
TYGRTTTPGNEPPASLEAE

SEQ ID NO: 7107 - protein, 19 aa, synthetic construct
  REGION 1..19: note = Synthetic
TYSRGESGPNEPPPGLTGP

SEQ ID NO: 7108 - protein, 19 aa, synthetic construct
  REGION 1..19: note = Synthetic
AWGRTGASENETPAPLGGE

SEQ ID NO: 7109 - protein, 19 aa, synthetic construct
  REGION 1..19: note = Synthetic
RWGRAETTPNTPPEGLETE

SEQ ID NO: 7110 - protein, 19 aa, synthetic construct
  REGION 1..19: note = Synthetic
ESGRAANHTGAEPPELGAG

SEQ ID NO: 7111 - protein, 19 aa, synthetic construct
  REGION 1..19: note = Synthetic
TTGRAGEAANLTPAGLTES

SEQ ID NO: 7112 - protein, 19 aa, synthetic construct
  REGION 1..19: note = Synthetic
TTGRAGEAANLTPAALTES

SEQ ID NO: 7113 - protein, 19 aa, synthetic construct
  REGION 1..19: note = Synthetic
TTGRAGEAANLTPAPLTES

SEQ ID NO: 7114 - protein, 19 aa, synthetic construct
  REGION 1..19: note = Synthetic
TTGRAGEAANLTPEPLTES

SEQ ID NO: 7115 - protein, 19 aa, synthetic construct
  REGION 1..19: note = Synthetic
TTGRAGEAANLTPAGLTGA

SEQ ID NO: 7116 - protein, 19 aa, synthetic construct
  REGION 1..19: note = Synthetic
TTGRAGEAANLTPEGLTGA

SEQ ID NO: 7117 - protein, 19 aa, synthetic construct
  REGION 1..19: note = Synthetic
TTGRAGEAANLTPEPLTGA

SEQ ID NO: 7118 - protein, 19 aa, synthetic construct
  REGION 1..19: note = Synthetic
TTGRAGEAANLTPAGLTEA

SEQ ID NO: 7119 - protein, 19 aa, synthetic construct
  REGION 1..19: note = Synthetic
TTGRAGEAANLTPEGLTEA

SEQ ID NO: 7120 - protein, 19 aa, synthetic construct
  REGION 1..19: note = Synthetic
TTGRAGEAANLTPAPLTEA

SEQ ID NO: 7121 - protein, 19 aa, synthetic construct
  REGION 1..19: note = Synthetic
TTGRAGEAANLTPEPLTEA

SEQ ID NO: 7122 - protein, 19 aa, synthetic construct
  REGION 1..19: note = Synthetic
TTGRAGEAANLTPEPLTGP

SEQ ID NO: 7123 - protein, 19 aa, synthetic construct
  REGION 1..19: note = Synthetic
TTGRAGEAANLTPAGLTGG

SEQ ID NO: 7124 - protein, 19 aa, synthetic construct
  REGION 1..19: note = Synthetic
TTGRAGEAANLTPEGLTGG

SEQ ID NO: 7125 - protein, 19 aa, synthetic construct
  REGION 1..19: note = Synthetic
TTGRAGEAANLTPEALTGG

SEQ ID NO: 7126 - protein, 19 aa, synthetic construct
  REGION 1..19: note = Synthetic
TTGRAGEAANLTPEPLTGG

SEQ ID NO: 7127 - protein, 19 aa, synthetic construct
  REGION 1..19: note = Synthetic
TTGRAGEAANLTPAGLTEG

SEQ ID NO: 7128 - protein, 19 aa, synthetic construct
  REGION 1..19: note = Synthetic
TTGRAGEAANLTPEGLTEG

SEQ ID NO: 7129 - protein, 19 aa, synthetic construct
  REGION 1..19: note = Synthetic
TTGRAGEAANLTPAPLTEG

SEQ ID NO: 7130 - protein, 19 aa, synthetic construct
  REGION 1..19: note = Synthetic
TTGRAGEAANLTPEPLTEG

SEQ ID NO: 7131 - protein, 29 aa, synthetic construct
  REGION 1..29: note = Synthetic
GSAPGSAGGYAELRMGGAIATSGSETPGT

SEQ ID NO: 7132 - protein, 29 aa, synthetic construct
  REGION 1..29: note = Synthetic
GSAPGTGGGYAPLRMGGGAATSGSETPGT

SEQ ID NO: 7133 - protein, 29 aa, synthetic construct
  REGION 1..29: note = Synthetic
GSAPGAEGGYAALRMGGEIATSGSETPGT

SEQ ID NO: 7134 - protein, 29 aa, synthetic construct
  REGION 1..29: note = Synthetic
GSAPGGPGGYALLRMGGPAATSGSETPGT

SEQ ID NO: 7135 - protein, 29 aa, synthetic construct
  REGION 1..29: note = Synthetic
GSAPGEAGGYAFLRMGGSIATSGSETPGT

SEQ ID NO: 7136 - protein, 29 aa, synthetic construct
  REGION 1..29: note = Synthetic
GSAPGPGGGYASLRMGGTAATSGSETPGT

SEQ ID NO: 7137 - protein, 29 aa, synthetic construct
  REGION 1..29: note = Synthetic
GSAPGSEGGYATLRMGGAIATSGSETPGT

SEQ ID NO: 7138 - protein, 29 aa, synthetic construct
  REGION 1..29: note = Synthetic
GSAPGTPGGYANLRMGGGAATSGSETPGT

SEQ ID NO: 7139 - protein, 29 aa, synthetic construct
  REGION 1..29: note = Synthetic
GSAPGASGGYAHLRMGGEIATSGSETPGT

SEQ ID NO: 7140 - protein, 29 aa, synthetic construct
  REGION 1..29: note = Synthetic
GSAPGGTGGYGELRMGGPAATSGSETPGT

SEQ ID NO: 7141 - protein, 29 aa, synthetic construct
  REGION 1..29: note = Synthetic
GSAPGEAGGYPELRMGGSIATSGSETPGT

SEQ ID NO: 7142 - protein, 29 aa, synthetic construct
  REGION 1..29: note = Synthetic
GSAPGPGGGYVELRMGGTAATSGSETPGT

SEQ ID NO: 7143 - protein, 29 aa, synthetic construct
  REGION 1..29: note = Synthetic
GSAPGSEGGYLELRMGGAIATSGSETPGT

SEQ ID NO: 7144 - protein, 29 aa, synthetic construct
  REGION 1..29: note = Synthetic
GSAPGTPGGYSELRMGGGAATSGSETPGT

SEQ ID NO: 7145 - protein, 29 aa, synthetic construct
  REGION 1..29: note = Synthetic
GSAPGASGGYTELRMGGEIATSGSETPGT

SEQ ID NO: 7146 - protein, 29 aa, synthetic construct
  REGION 1..29: note = Synthetic
GSAPGGTGGYQELRMGGPAATSGSETPGT

SEQ ID NO: 7147 - protein, 29 aa, synthetic construct
  REGION 1..29: note = Synthetic
GSAPGEAGGYEELRMGGSIATSGSETPGT

SEQ ID NO: 7148 - protein, 29 aa, synthetic construct
  REGION 1..29: note = Synthetic
GSAPGPGIGPAELRMGGTAATSGSETPGT

SEQ ID NO: 7149 - protein, 29 aa, synthetic construct
  REGION 1..29: note = Synthetic
GSAPGSEIGAAELRMGGAIATSGSETPGT

SEQ ID NO: 7150 - protein, 29 aa, synthetic construct
  REGION 1..29: note = Synthetic
GSAPGTPIGSAELRMGGGAATSGSETPGT

SEQ ID NO: 7151 - protein, 29 aa, synthetic construct
  REGION 1..29: note = Synthetic
GSAPGASIGTAELRMGGEIATSGSETPGT

SEQ ID NO: 7152 - protein, 29 aa, synthetic construct
  REGION 1..29: note = Synthetic
GSAPGGTIGNAELRMGGPAATSGSETPGT

SEQ ID NO: 7153 - protein, 29 aa, synthetic construct
  REGION 1..29: note = Synthetic
GSAPGEAIGQAELRMGGSIATSGSETPGT

SEQ ID NO: 7154 - protein, 29 aa, synthetic construct
  REGION 1..29: note = Synthetic
GSAPGPGGPYAELRMGGTAATSGSETPGT

SEQ ID NO: 7155 - protein, 29 aa, synthetic construct
  REGION 1..29: note = Synthetic
GSAPGSEGAYAELRMGGAIATSGSETPGT

SEQ ID NO: 7156 - protein, 29 aa, synthetic construct
  REGION 1..29: note = Synthetic
GSAPGTPGVYAELRMGGGAATSGSETPGT

SEQ ID NO: 7157 - protein, 29 aa, synthetic construct
  REGION 1..29: note = Synthetic
GSAPGASGLYAELRMGGEIATSGSETPGT

SEQ ID NO: 7158 - protein, 29 aa, synthetic construct
  REGION 1..29: note = Synthetic
GSAPGGTGIYAELRMGGPAATSGSETPGT

SEQ ID NO: 7159 - protein, 29 aa, synthetic construct
  REGION 1..29: note = Synthetic
GSAPGEAGFYAELRMGGSIATSGSETPGT

SEQ ID NO: 7160 - protein, 29 aa, synthetic construct
  REGION 1..29: note = Synthetic
GSAPGPGGYYAELRMGGTAATSGSETPGT

SEQ ID NO: 7161 - protein, 29 aa, synthetic construct
  REGION 1..29: note = Synthetic
GSAPGSEGSYAELRMGGAIATSGSETPGT

SEQ ID NO: 7162 - protein, 29 aa, synthetic construct
  REGION 1..29: note = Synthetic
GSAPGTPGNYAELRMGGGAATSGSETPGT

SEQ ID NO: 7163 - protein, 29 aa, synthetic construct
  REGION 1..29: note = Synthetic
GSAPGASGEYAELRMGGEIATSGSETPGT

SEQ ID NO: 7164 - protein, 29 aa, synthetic construct
  REGION 1..29: note = Synthetic
GSAPGGTGHYAELRMGGPAATSGSETPGT

SEQ ID NO: 7165 - protein, 29 aa, synthetic construct
  REGION 1..29: note = Synthetic
GSAPGEAGGYAEARMGGSIATSGSETPGT

SEQ ID NO: 7166 - protein, 29 aa, synthetic construct
  REGION 1..29: note = Synthetic
GSAPGPGGGYAEVRMGGTAATSGSETPGT

SEQ ID NO: 7167 - protein, 29 aa, synthetic construct
  REGION 1..29: note = Synthetic
GSAPGSEGGYAEIRMGGAIATSGSETPGT

SEQ ID NO: 7168 - protein, 29 aa, synthetic construct
  REGION 1..29: note = Synthetic
GSAPGTPGGYAEFRMGGGAATSGSETPGT

SEQ ID NO: 7169 - protein, 29 aa, synthetic construct
  REGION 1..29: note = Synthetic
GSAPGASGGYAEYRMGGEIATSGSETPGT

SEQ ID NO: 7170 - protein, 29 aa, synthetic construct
  REGION 1..29: note = Synthetic
GSAPGGTGGYAESRMGGPAATSGSETPGT

SEQ ID NO: 7171 - protein, 29 aa, synthetic construct
  REGION 1..29: note = Synthetic
GSAPGEAGGYAETRMGGSIATSGSETPGT

SEQ ID NO: 7172 - protein, 29 aa, synthetic construct
  REGION 1..29: note = Synthetic
GSAPGPGGGYAELAMGGTRATSGSETPGT

SEQ ID NO: 7173 - protein, 29 aa, synthetic construct
  REGION 1..29: note = Synthetic
GSAPGSEGGYAELVMGGARATSGSETPGT

SEQ ID NO: 7174 - protein, 29 aa, synthetic construct
  REGION 1..29: note = Synthetic
GSAPGTPGGYAELLMGGGRATSGSETPGT

SEQ ID NO: 7175 - protein, 29 aa, synthetic construct
  REGION 1..29: note = Synthetic
GSAPGASGGYAELIMGGERATSGSETPGT

SEQ ID NO: 7176 - protein, 29 aa, synthetic construct
  REGION 1..29: note = Synthetic
GSAPGGTGGYAELWMGGPRATSGSETPGT

SEQ ID NO: 7177 - protein, 29 aa, synthetic construct
  REGION 1..29: note = Synthetic
GSAPGEAGGYAELSMGGSRATSGSETPGT

SEQ ID NO: 7178 - protein, 29 aa, synthetic construct
  REGION 1..29: note = Synthetic
GSAPGPGGGYAELTMGGTRATSGSETPGT

SEQ ID NO: 7179 - protein, 29 aa, synthetic construct
  REGION 1..29: note = Synthetic
GSAPGSEGGYAELQMGGARATSGSETPGT

SEQ ID NO: 7180 - protein, 29 aa, synthetic construct
  REGION 1..29: note = Synthetic
GSAPGTPGGYAELNMGGGRATSGSETPGT

SEQ ID NO: 7181 - protein, 29 aa, synthetic construct
  REGION 1..29: note = Synthetic
GSAPGASGGYAELEMGGERATSGSETPGT

SEQ ID NO: 7182 - protein, 29 aa, synthetic construct
  REGION 1..29: note = Synthetic
GSAPGGTGGYAELRPGGPIATSGSETPGT

SEQ ID NO: 7183 - protein, 29 aa, synthetic construct
  REGION 1..29: note = Synthetic
GSAPGEAGGYAELRAGGSAATSGSETPGT

SEQ ID NO: 7184 - protein, 29 aa, synthetic construct
  REGION 1..29: note = Synthetic
GSAPGPGGGYAELRLGGTIATSGSETPGT

SEQ ID NO: 7185 - protein, 29 aa, synthetic construct
  REGION 1..29: note = Synthetic
GSAPGSEGGYAELRIGGAAATSGSETPGT

SEQ ID NO: 7186 - protein, 29 aa, synthetic construct
  REGION 1..29: note = Synthetic
GSAPGTPGGYAELRSGGGIATSGSETPGT

SEQ ID NO: 7187 - protein, 29 aa, synthetic construct
  REGION 1..29: note = Synthetic
GSAPGASGGYAELRNGGEAATSGSETPGT

SEQ ID NO: 7188 - protein, 29 aa, synthetic construct
  REGION 1..29: note = Synthetic
GSAPGGTGGYAELRQGGPIATSGSETPGT

SEQ ID NO: 7189 - protein, 29 aa, synthetic construct
  REGION 1..29: note = Synthetic
GSAPGEAGGYAELRDGGSAATSGSETPGT

SEQ ID NO: 7190 - protein, 29 aa, synthetic construct
  REGION 1..29: note = Synthetic
GSAPGPGGGYAELREGGTIATSGSETPGT

SEQ ID NO: 7191 - protein, 29 aa, synthetic construct
  REGION 1..29: note = Synthetic
GSAPGSEGGYAELRHGGAAATSGSETPGT

SEQ ID NO: 7192 - protein, 29 aa, synthetic construct
  REGION 1..29: note = Synthetic
GSAPGTPGGYAELRMPGGIATSGSETPGT

SEQ ID NO: 7193 - protein, 29 aa, synthetic construct
  REGION 1..29: note = Synthetic
GSAPGASGGYAELRMAGEAATSGSETPGT

SEQ ID NO: 7194 - protein, 29 aa, synthetic construct
  REGION 1..29: note = Synthetic
GSAPGGTGGYAELRMVGPIATSGSETPGT

SEQ ID NO: 7195 - protein, 29 aa, synthetic construct
  REGION 1..29: note = Synthetic
GSAPGEAGGYAELRMLGSAATSGSETPGT

SEQ ID NO: 7196 - protein, 29 aa, synthetic construct
  REGION 1..29: note = Synthetic
GSAPGPGGGYAELRMIGTIATSGSETPGT

SEQ ID NO: 7197 - protein, 29 aa, synthetic construct
  REGION 1..29: note = Synthetic
GSAPGSEGGYAELRMYGAIATSGSETPGT

SEQ ID NO: 7198 - protein, 29 aa, synthetic construct
  REGION 1..29: note = Synthetic
GSAPGTPGGYAELRMSGGAATSGSETPGT

SEQ ID NO: 7199 - protein, 29 aa, synthetic construct
  REGION 1..29: note = Synthetic
GSAPGASGGYAELRMNGEIATSGSETPGT

SEQ ID NO: 7200 - protein, 29 aa, synthetic construct
  REGION 1..29: note = Synthetic
GSAPGGTGGYAELRMQGPAATSGSETPGT

SEQ ID NO: 7201 - protein, 29 aa, synthetic construct
  REGION 1..29: note = Synthetic
GSAPGANHTPAGLTGPGARATSGSETPGT

SEQ ID NO: 7202 - protein, 29 aa, synthetic construct
  REGION 1..29: note = Synthetic
GSAPGANTAPEGLTGPSTRATSGSETPGT

SEQ ID NO: 7203 - protein, 29 aa, synthetic construct
  REGION 1..29: note = Synthetic
GSAPGTGAPPGGLTGPGTRATSGSETPGT

SEQ ID NO: 7204 - protein, 29 aa, synthetic construct
  REGION 1..29: note = Synthetic
GSAPGANHEPSGLTEGSPRATSGSETPGT

SEQ ID NO: 7205 - protein, 29 aa, synthetic construct
  REGION 1..29: note = Synthetic
GSAPGANTEPPELGAGTERATSGSETPGT

SEQ ID NO: 7206 - protein, 29 aa, synthetic construct
  REGION 1..29: note = Synthetic
GSAPGASGPPPGLTGPPGRATSGSETPGT

SEQ ID NO: 7207 - protein, 29 aa, synthetic construct
  REGION 1..29: note = Synthetic
GSAPGASGTPAPLGGEPGRATSGSETPGT

SEQ ID NO: 7208 - protein, 29 aa, synthetic construct
  REGION 1..29: note = Synthetic
GSAPGPAGPPEGLETEAGRATSGSETPGT

SEQ ID NO: 7209 - protein, 29 aa, synthetic construct
  REGION 1..29: note = Synthetic
GSAPGPTSGQGGLTGPESRATSGSETPGT

SEQ ID NO: 7210 - protein, 29 aa, synthetic construct
  REGION 1..29: note = Synthetic
GSAPGSAGGAANLVRGGAIATSGSETPGT

SEQ ID NO: 7211 - protein, 29 aa, synthetic construct
  REGION 1..29: note = Synthetic
GSAPGTGGGAAPLVRGGGAATSGSETPGT

SEQ ID NO: 7212 - protein, 29 aa, synthetic construct
  REGION 1..29: note = Synthetic
GSAPGAEGGAAALVRGGEIATSGSETPGT

SEQ ID NO: 7213 - protein, 29 aa, synthetic construct
  REGION 1..29: note = Synthetic
GSAPGGPGGAALLVRGGPAATSGSETPGT

SEQ ID NO: 7214 - protein, 29 aa, synthetic construct
  REGION 1..29: note = Synthetic
GSAPGEAGGAAFLVRGGSIATSGSETPGT

SEQ ID NO: 7215 - protein, 29 aa, synthetic construct
  REGION 1..29: note = Synthetic
GSAPGPGGGAASLVRGGTAATSGSETPGT

SEQ ID NO: 7216 - protein, 29 aa, synthetic construct
  REGION 1..29: note = Synthetic
GSAPGSEGGAATLVRGGAIATSGSETPGT

SEQ ID NO: 7217 - protein, 29 aa, synthetic construct
  REGION 1..29: note = Synthetic
GSAPGTPGGAAGLVRGGGAATSGSETPGT

SEQ ID NO: 7218 - protein, 29 aa, synthetic construct
  REGION 1..29: note = Synthetic
GSAPGASGGAADLVRGGEIATSGSETPGT

SEQ ID NO: 7219 - protein, 29 aa, synthetic construct
  REGION 1..29: note = Synthetic
GSAPGGTGGAGNLVRGGPAATSGSETPGT

SEQ ID NO: 7220 - protein, 29 aa, synthetic construct
  REGION 1..29: note = Synthetic
GSAPGEAGGAPNLVRGGSIATSGSETPGT

SEQ ID NO: 7221 - protein, 29 aa, synthetic construct
  REGION 1..29: note = Synthetic
GSAPGPGGGAVNLVRGGTAATSGSETPGT

SEQ ID NO: 7222 - protein, 29 aa, synthetic construct
  REGION 1..29: note = Synthetic
GSAPGSEGGALNLVRGGAIATSGSETPGT

SEQ ID NO: 7223 - protein, 29 aa, synthetic construct
  REGION 1..29: note = Synthetic
GSAPGTPGGASNLVRGGGAATSGSETPGT

SEQ ID NO: 7224 - protein, 29 aa, synthetic construct
  REGION 1..29: note = Synthetic
GSAPGASGGATNLVRGGEIATSGSETPGT

SEQ ID NO: 7225 - protein, 29 aa, synthetic construct
  REGION 1..29: note = Synthetic
GSAPGGTGGAQNLVRGGPAATSGSETPGT

SEQ ID NO: 7226 - protein, 29 aa, synthetic construct
  REGION 1..29: note = Synthetic
GSAPGEAGGAENLVRGGSIATSGSETPGT

SEQ ID NO: 7227 - protein, 30 aa, synthetic construct
  REGION 1..30: note = Synthetic
GSAPEAGRSANHEPLGLVATATSGSETPGT

SEQ ID NO: 7228 - protein, 30 aa, synthetic construct
  REGION 1..30: note = Synthetic
GSAPASGRSTNAGPSGLAGPATSGSETPGT

SEQ ID NO: 7229 - protein, 30 aa, synthetic construct
  REGION 1..30: note = Synthetic
GSAPASGRSTNAGPQGLAGQATSGSETPGT

SEQ ID NO: 7230 - protein, 30 aa, synthetic construct
  REGION 1..30: note = Synthetic
GSAPASGRSTNAGPPGLTGPATSGSETPGT

SEQ ID NO: 7231 - protein, 30 aa, synthetic construct
  REGION 1..30: note = Synthetic
GSAPASSRGTNAGPAGLTGPATSGSETPGT

SEQ ID NO: 7232 - protein, 30 aa, synthetic construct
  REGION 1..30: note = Synthetic
GSAPASSRTTNTGPSTLTGPATSGSETPGT

SEQ ID NO: 7233 - protein, 30 aa, synthetic construct
  REGION 1..30: note = Synthetic
GSAPAAGRSDNGTPLELVAPATSGSETPGT

SEQ ID NO: 7234 - protein, 30 aa, synthetic construct; identical to SEQ ID NO: 7227
  REGION 1..30: note = Synthetic

SEQ ID NO: 7235 - protein, 30 aa, synthetic construct
  REGION 1..30: note = Synthetic
GSAPASGRGTNAGPAGLTGPATSGSETPGT

SEQ ID NO: 7236 - protein, 30 aa, synthetic construct
  REGION 1..30: note = Synthetic
GSAPLFGRNDNHEPLELGGGATSGSETPGT

SEQ ID NO: 7237 - protein, 30 aa, synthetic construct
  REGION 1..30: note = Synthetic
GSAPTAGRSDNLEPLGLVFGATSGSETPGT

SEQ ID NO: 7238 - protein, 30 aa, synthetic construct
  REGION 1..30: note = Synthetic
GSAPLDGRSDNFHPPELVAGATSGSETPGT

SEQ ID NO: 7239 - protein, 30 aa, synthetic construct
  REGION 1..30: note = Synthetic
GSAPLEGRSDNEEPENLVAGATSGSETPGT

SEQ ID NO: 7240 - protein, 30 aa, synthetic construct
  REGION 1..30: note = Synthetic
GSAPLKGRSDNNAPLALVAGATSGSETPGT

SEQ ID NO: 7241 - protein, 30 aa, synthetic construct
  REGION 1..30: note = Synthetic
GSAPVYSRGTNAGPHGLTGRATSGSETPGT

SEQ ID NO: 7242 - protein, 30 aa, synthetic construct
  REGION 1..30: note = Synthetic
GSAPANSRGTNKGFAGLIGPATSGSETPGT

SEQ ID NO: 7243 - protein, 30 aa, synthetic construct
  REGION 1..30: note = Synthetic
GSAPASSRLTNEAPAGLTIPATSGSETPGT

SEQ ID NO: 7244 - protein, 30 aa, synthetic construct
  REGION 1..30: note = Synthetic
GSAPDQSRGTNAGPEGLTDPATSGSETPGT

SEQ ID NO: 7245 - protein, 30 aa, synthetic construct
  REGION 1..30: note = Synthetic
GSAPESSRGTNIGQGGLTGPATSGSETPGT

SEQ ID NO: 7246 - protein, 30 aa, synthetic construct
  REGION 1..30: note = Synthetic
GSAPSSSRGTNQDPAGLTIPATSGSETPGT

SEQ ID NO: 7247 - protein, 30 aa, synthetic construct
  REGION 1..30: note = Synthetic
GSAPASSRGQNHSPMGLTGPATSGSETPGT

SEQ ID NO: 7248 - protein, 30 aa, synthetic construct
  REGION 1..30: note = Synthetic
GSAPAYSRGPNAGPAGLEGRATSGSETPGT

SEQ ID NO: 7249 - protein, 30 aa, synthetic construct
  REGION 1..30: note = Synthetic
GSAPASERGNNAGPANLTGFATSGSETPGT

SEQ ID NO: 7250 - protein, 30 aa, synthetic construct
  REGION 1..30: note = Synthetic
GSAPASHRGTNPKPAILTGPATSGSETPGT

SEQ ID NO: 7251 - protein, 30 aa, synthetic construct
  REGION 1..30: note = Synthetic
GSAPMSSRRTNANPAQLTGPATSGSETPGT

SEQ ID NO: 7252 - protein, 30 aa, synthetic construct
  REGION 1..30: note = Synthetic
GSAPGAGRTDNHEPLELGAAATSGSETPGT

SEQ ID NO: 7253 - protein, 30 aa, synthetic construct
  REGION 1..30: note = Synthetic
GSAPLAGRSENTAPLELTAGATSGSETPGT

SEQ ID NO: 7254 - protein, 30 aa, synthetic construct
  REGION 1..30: note = Synthetic
GSAPLEGRPDNHEPLALVASATSGSETPGT

SEQ ID NO: 7255 - protein, 30 aa, synthetic construct
  REGION 1..30: note = Synthetic
GSAPLSGRSDNEEPLALPAGATSGSETPGT

SEQ ID NO: 7256 - protein, 30 aa, synthetic construct
  REGION 1..30: note = Synthetic
GSAPEAGRTDNHEPLELSAPATSGSETPGT

SEQ ID NO: 7257 - protein, 30 aa, synthetic construct
  REGION 1..30: note = Synthetic
GSAPEGGRSDNHGPLELVSGATSGSETPGT

SEQ ID NO: 7258 - protein, 30 aa, synthetic construct
  REGION 1..30: note = Synthetic
GSAPLSGRSDNEAPLELEAGATSGSETPGT

SEQ ID NO: 7259 - protein, 30 aa, synthetic construct
  REGION 1..30: note = Synthetic
GSAPLGGRADNHEPPELGAGATSGSETPGT

SEQ ID NO: 7260 - protein, 30 aa, synthetic construct
  REGION 1..30: note = Synthetic
GSAPPPSRGTNAEPAGLTGEATSGSETPGT

SEQ ID NO: 7261 - protein, 30 aa, synthetic construct
  REGION 1..30: note = Synthetic
GSAPASTRGENAGPAGLEAPATSGSETPGT

SEQ ID NO: 7262 - protein, 30 aa, synthetic construct
  REGION 1..30: note = Synthetic
GSAPESSRGTNGAPEGLTGPATSGSETPGT

SEQ ID NO: 7263 - protein, 30 aa, synthetic construct
  REGION 1..30: note = Synthetic
GSAPASSRATNESPAGLTGEATSGSETPGT

SEQ ID NO: 7264 - protein, 30 aa, synthetic construct
  REGION 1..30: note = Synthetic
GSAPASSRGENPPPGGLTGPATSGSETPGT

SEQ ID NO: 7265 - protein, 30 aa, synthetic construct
  REGION 1..30: note = Synthetic
GSAPAASRGTNTGPAELTGSATSGSETPGT

SEQ ID NO: 7266 - protein, 30 aa, synthetic construct
  REGION 1..30: note = Synthetic
GSAPAGSRTTNAGPGGLEGPATSGSETPGT

SEQ ID NO: 7267 - protein, 30 aa, synthetic construct
  REGION 1..30: note = Synthetic
GSAPAPSRGENAGPATLTGAATSGSETPGT

SEQ ID NO: 7268 - protein, 30 aa, synthetic construct
  REGION 1..30: note = Synthetic
GSAPESGRAANTGPPTLTAPATSGSETPGT

SEQ ID NO: 7269 - protein, 30 aa, synthetic construct
  REGION 1..30: note = Synthetic
GSAPNPGRAANEGPPGLPGSATSGSETPGT

SEQ ID NO: 7270 - protein, 30 aa, synthetic construct
  REGION 1..30: note = Synthetic
GSAPESSRAANLTPPELTGPATSGSETPGT

SEQ ID NO: 7271 - protein, 30 aa, synthetic construct
  REGION 1..30: note = Synthetic
GSAPASGRAANETPPGLTGAATSGSETPGT

SEQ ID NO: 7272 - protein, 30 aa, synthetic construct
  REGION 1..30: note = Synthetic
GSAPNSGRGENLGAPGLTGTATSGSETPGT

SEQ ID NO: 7273 - protein, 30 aa, synthetic construct
  REGION 1..30: note = Synthetic
GSAPTTGRAANLTPAGLTGPATSGSETPGT

SEQ ID NO: 7274 - protein, 30 aa, synthetic construct
  REGION 1..30: note = Synthetic
GSAPEAGRSANHTPAGLTGPATSGSETPGT

SEQ ID NO: 7275 - protein, 30 aa, synthetic construct
  REGION 1..30: note = Synthetic
GSAPESGRAANTTPAGLTGPATSGSETPGT

SEQ ID NO: 7276 - protein, 33 aa, synthetic construct
  REGION 1..33: note = Synthetic
GSAPTTGRATEAANLTPAGLTGPATSGSETPGT

SEQ ID NO: 7277 - protein, 33 aa, synthetic construct
  REGION 1..33: note = Synthetic
GSAPTTGRAEEAANLTPAGLTGPATSGSETPGT

SEQ ID NO: 7278 - protein, 33 aa, synthetic construct
  REGION 1..33: note = Synthetic
GSAPTTGRAGEAANLTPAGLTGPATSGSETPGT

SEQ ID NO: 7279 - protein, 33 aa, synthetic construct
  REGION 1..33: note = Synthetic
GSAPTTGRATEAANATPAGLTGPATSGSETPGT

SEQ ID NO: 7280 - protein, 33 aa, synthetic construct
  REGION 1..33: note = Synthetic
GSAPTTGRAGEAEGATSAGATGPATSGSETPGT

SEQ ID NO: 7281 - protein, 33 aa, synthetic construct
  REGION 1..33: note = Synthetic
GSAPTTGEAGEAANATSAGATGPATSGSETPGT

SEQ ID NO: 7282 - protein, 33 aa, synthetic construct
  REGION 1..33: note = Synthetic
GSAPTTGEAGEAAGLTPAGLTGPATSGSETPGT

SEQ ID NO: 7283 - protein, 33 aa, synthetic construct
  REGION 1..33: note = Synthetic
GSAPTTGAAGEAANATPAGLTGPATSGSETPGT

SEQ ID NO: 7284 - protein, 33 aa, synthetic construct
  REGION 1..33: note = Synthetic
GSAPTTGRAGEAAGLTPAGLTGPATSGSETPGT

SEQ ID NO: 7285 - protein, 33 aa, synthetic construct
  REGION 1..33: note = Synthetic
GSAPTTGRAGEAANATSAGATGPATSGSETPGT

SEQ ID NO: 7286 - protein, 33 aa, synthetic construct
  REGION 1..33: note = Synthetic
GSAPTTGEAGEAAGATSAGATGPATSGSETPGT

SEQ ID NO: 7287 - protein, 30 aa, synthetic construct
  REGION 1..30: note = Synthetic
GSAPESGRAANTEPPELGAGATSGSETPGT

SEQ ID NO: 7288 - protein, 30 aa, synthetic construct
  REGION 1..30: note = Synthetic
GSAPESGRAANTAPEGLTGPATSGSETPGT

SEQ ID NO: 7289 - protein, 30 aa, synthetic construct
  REGION 1..30: note = Synthetic
GSAPEPGRAANHEPSGLTEGATSGSETPGT

SEQ ID NO: 7290 - protein, 33 aa, synthetic construct
  REGION 1..33: note = Synthetic
GSAPESGRAANHTGAPPGGLTGPATSGSETPGT

SEQ ID NO: 7291 - protein, 33 aa, synthetic construct
  REGION 1..33: note = Synthetic
GSAPTTGRTGEGANATPGGLTGPATSGSETPGT

SEQ ID NO: 7292 - protein, 33 aa, synthetic construct
  REGION 1..33: note = Synthetic
GSAPRTGRSGEAANETPEGLEGPATSGSETPGT

SEQ ID NO: 7293 - protein, 33 aa, synthetic construct
  REGION 1..33: note = Synthetic
GSAPRTGRTGESANETPAGLGGPATSGSETPGT

SEQ ID NO: 7294 - protein, 33 aa, synthetic construct
  REGION 1..33: note = Synthetic
GSAPSTGRTGEPANETPAGLSGPATSGSETPGT

SEQ ID NO: 7295 - protein, 33 aa, synthetic construct
  REGION 1..33: note = Synthetic
GSAPTTGRAGEPANATPTGLSGPATSGSETPGT

SEQ ID NO: 7296 - protein, 33 aa, synthetic construct
  REGION 1..33: note = Synthetic
GSAPRTGRPGEGANATPTGLPGPATSGSETPGT

SEQ ID NO: 7297 - protein, 33 aa, synthetic construct
  REGION 1..33: note = Synthetic
GSAPRTGRGGEAANATPSGLGGPATSGSETPGT

SEQ ID NO: 7298 - protein, 33 aa, synthetic construct
  REGION 1..33: note = Synthetic
GSAPSTGRSGESANATPGGLGGPATSGSETPGT

SEQ ID NO: 7299 - protein, 33 aa, synthetic construct
  REGION 1..33: note = Synthetic
GSAPRTGRTGEEANATPAGLPGPATSGSETPGT

SEQ ID NO: 7300 - protein, 33 aa, synthetic construct
  REGION 1..33: note = Synthetic
GSAPATGRPGEPANTTPEGLEGPATSGSETPGT

SEQ ID NO: 7301 - protein, 33 aa, synthetic construct
  REGION 1..33: note = Synthetic
GSAPSTGRSGEPANATPGGLTGPATSGSETPGT

SEQ ID NO: 7302 - protein, 33 aa, synthetic construct
  REGION 1..33: note = Synthetic
GSAPPTGRGGEGANTTPTGLPGPATSGSETPGT

SEQ ID NO: 7303 - protein, 33 aa, synthetic construct
  REGION 1..33: note = Synthetic
GSAPPTGRSGEGANATPSGLTGPATSGSETPGT

SEQ ID NO: 7304 - protein, 33 aa, synthetic construct
  REGION 1..33: note = Synthetic
GSAPTTGRASEGANSTPAPLTEPATSGSETPGT

SEQ ID NO: 7305 - protein, 33 aa, synthetic construct
  REGION 1..33: note = Synthetic
GSAPTYGRAAEAANTTPAGLTAPATSGSETPGT

SEQ ID NO: 7306 - protein, 33 aa, synthetic construct
  REGION 1..33: note = Synthetic
GSAPTTGRATEGANATPAELTEPATSGSETPGT

SEQ ID NO: 7307 - protein, 33 aa, synthetic construct
  REGION 1..33: note = Synthetic
GSAPTVGRASEEANTTPASLTGPATSGSETPGT

SEQ ID NO: 7308 - protein, 33 aa, synthetic construct
  REGION 1..33: note = Synthetic
GSAPTTGRAPEAANATPAPLTGPATSGSETPGT

SEQ ID NO: 7309 - protein, 33 aa, synthetic construct
  REGION 1..33: note = Synthetic
GSAPTWGRATEPANATPAPLTSPATSGSETPGT

SEQ ID NO: 7310 - protein, 33 aa, synthetic construct
  REGION 1..33: note = Synthetic
GSAPTVGRASESANATPAELTSPATSGSETPGT

SEQ ID NO: 7311 - protein, 33 aa, synthetic construct
  REGION 1..33: note = Synthetic
GSAPTVGRAPEGANSTPAGLTGPATSGSETPGT

SEQ ID NO: 7312 - protein, 33 aa, synthetic construct
  REGION 1..33: note = Synthetic
GSAPTWGRATEAPNLEPATLTTPATSGSETPGT

SEQ ID NO: 7313 - protein, 33 aa, synthetic construct
  REGION 1..33: note = Synthetic
GSAPTTGRATEAPNLTPAPLTEPATSGSETPGT

SEQ ID NO: 7314 - protein, 33 aa, synthetic construct
  REGION 1..33: note = Synthetic
GSAPTQGRATEAPNLSPAALTSPATSGSETPGT

SEQ ID NO: 7315 - protein, 33 aa, synthetic construct
  REGION 1..33: note = Synthetic
GSAPTQGRAAEAPNLTPATLTAPATSGSETPGT

SEQ ID NO: 7316 - protein, 33 aa, synthetic construct
  REGION 1..33: note = Synthetic
GSAPTSGRAPEATNLAPAPLTGPATSGSETPGT

SEQ ID NO: 7317 - protein, 33 aa, synthetic construct
  REGION 1..33: note = Synthetic
GSAPTQGRAAEAANLTPAGLTEPATSGSETPGT

SEQ ID NO: 7318 - protein, 33 aa, synthetic construct
  REGION 1..33: note = Synthetic
GSAPTTGRAGSAPNLPPTGLTTPATSGSETPGT

SEQ ID NO: 7319 - protein, 33 aa, synthetic construct
  REGION 1..33: note = Synthetic
GSAPTTGRAGGAENLPPEGLTAPATSGSETPGT

SEQ ID NO: 7320 - protein, 33 aa, synthetic construct
  REGION 1..33: note = Synthetic
GSAPTTSRAGTATNLTPEGLTAPATSGSETPGT

SEQ ID NO: 7321 - protein, 33 aa, synthetic construct
  REGION 1..33: note = Synthetic
GSAPTTGRAGTATNLPPSGLTTPATSGSETPGT

SEQ ID NO: 7322 - protein, 33 aa, synthetic construct
  REGION 1..33: note = Synthetic
GSAPTTARAGEAENLSPSGLTAPATSGSETPGT

SEQ ID NO: 7323 - protein, 33 aa, synthetic construct
  REGION 1..33: note = Synthetic
GSAPTTGRAGGAGNLAPGGLTEPATSGSETPGT

SEQ ID NO: 7324 - protein, 33 aa, synthetic construct
  REGION 1..33: note = Synthetic
GSAPTTGRAGTATNLPPEGLTGPATSGSETPGT

SEQ ID NO: 7325 - protein, 33 aa, synthetic construct
  REGION 1..33: note = Synthetic
GSAPTTGRAGGAANLAPTGLTEPATSGSETPGT

SEQ ID NO: 7326 - protein, 33 aa, synthetic construct
  REGION 1..33: note = Synthetic
GSAPTTGRAGTAENLAPSGLTTPATSGSETPGT

SEQ ID NO: 7327 - protein, 33 aa, synthetic construct
  REGION 1..33: note = Synthetic
GSAPTTGRAGSATNLGPGGLTGPATSGSETPGT

SEQ ID NO: 7328 - protein, 33 aa, synthetic construct
  REGION 1..33: note = Synthetic
GSAPTTARAGGAENLTPAGLTEPATSGSETPGT

SEQ ID NO: 7329 - protein, 33 aa, synthetic construct
  REGION 1..33: note = Synthetic
GSAPTTARAGSAENLSPSGLTGPATSGSETPGT

SEQ ID NO: 7330 - protein, 33 aa, synthetic construct
  REGION 1..33: note = Synthetic
GSAPTTARAGGAGNLAPEGLTTPATSGSETPGT

SEQ ID NO: 7331 - protein, 33 aa, synthetic construct
  REGION 1..33: note = Synthetic
GSAPTTSRAGAAENLTPTGLTGPATSGSETPGT

SEQ ID NO: 7332 - protein, 33 aa, synthetic construct
  REGION 1..33: note = Synthetic
GSAPTYGRTTTPGNEPPASLEAEATSGSETPGT

SEQ ID NO: 7333 - protein, 33 aa, synthetic construct
  REGION 1..33: note = Synthetic
GSAPTYSRGESGPNEPPPGLTGPATSGSETPGT

SEQ ID NO: 7334 - protein, 33 aa, synthetic construct
  REGION 1..33: note = Synthetic
GSAPAWGRTGASENETPAPLGGEATSGSETPGT

SEQ ID NO: 7335 - protein, 33 aa, synthetic construct
  REGION 1..33: note = Synthetic
GSAPRWGRAETTPNTPPEGLETEATSGSETPGT

SEQ ID NO: 7336 - protein, 33 aa, synthetic construct
  REGION 1..33: note = Synthetic
GSAPESGRAANHTGAEPPELGAGATSGSETPGT

SEQ ID NO: 7337 - protein, 33 aa, synthetic construct
  REGION 1..33: note = Synthetic
GSAPTTGRAGEAANLTPAGLTESATSGSETPGT

SEQ ID NO: 7338 - protein, 33 aa, synthetic construct
  REGION 1..33: note = Synthetic
GSAPTTGRAGEAANLTPAALTESATSGSETPGT

SEQ ID NO: 7339 - protein, 33 aa, synthetic construct
  REGION 1..33: note = Synthetic
GSAPTTGRAGEAANLTPAPLTESATSGSETPGT

SEQ ID NO: 7340 - protein, 33 aa, synthetic construct
  REGION 1..33: note = Synthetic
GSAPTTGRAGEAANLTPEPLTESATSGSETPGT

SEQ ID NO: 7341 - protein, 33 aa, synthetic construct
  REGION 1..33: note = Synthetic
GSAPTTGRAGEAANLTPAGLTGAATSGSETPGT

SEQ ID NO: 7342 - protein, 33 aa, synthetic construct
  REGION 1..33: note = Synthetic
GSAPTTGRAGEAANLTPEGLTGAATSGSETPGT

SEQ ID NO: 7343 - protein, 33 aa, synthetic construct
  REGION 1..33: note = Synthetic
GSAPTTGRAGEAANLTPEPLTGAATSGSETPGT

SEQ ID NO: 7344 - protein, 33 aa, synthetic construct
  REGION 1..33: note = Synthetic
GSAPTTGRAGEAANLTPAGLTEAATSGSETPGT

SEQ ID NO: 7345 - protein, 33 aa, synthetic construct
  REGION 1..33: note = Synthetic
GSAPTTGRAGEAANLTPEGLTEAATSGSETPGT

SEQ ID NO: 7346 - protein, 33 aa, synthetic construct
  REGION 1..33: note = Synthetic
GSAPTTGRAGEAANLTPAPLTEAATSGSETPGT

SEQ ID NO: 7347 - protein, 33 aa, synthetic construct
  REGION 1..33: note = Synthetic
GSAPTTGRAGEAANLTPEPLTEAATSGSETPGT

SEQ ID NO: 7348 - protein, 33 aa, synthetic construct
  REGION 1..33: note = Synthetic
GSAPTTGRAGEAANLTPEPLTGPATSGSETPGT

SEQ ID NO: 7349 - protein, 33 aa, synthetic construct
  REGION 1..33: note = Synthetic
GSAPTTGRAGEAANLTPAGLTGGATSGSETPGT

SEQ ID NO: 7350 - protein, 33 aa, synthetic construct
  REGION 1..33: note = Synthetic
GSAPTTGRAGEAANLTPEGLTGGATSGSETPGT

SEQ ID NO: 7351 - protein, 33 aa, synthetic construct
  REGION 1..33: note = Synthetic
GSAPTTGRAGEAANLTPEALTGGATSGSETPGT

SEQ ID NO: 7352 - protein, 33 aa, synthetic construct
  REGION 1..33: note = Synthetic
GSAPTTGRAGEAANLTPEPLTGGATSGSETPGT

SEQ ID NO: 7353 - protein, 33 aa, synthetic construct
  REGION 1..33: note = Synthetic
GSAPTTGRAGEAANLTPAGLTEGATSGSETPGT

SEQ ID NO: 7354 - protein, 33 aa, synthetic construct
  REGION 1..33: note = Synthetic
GSAPTTGRAGEAANLTPEGLTEGATSGSETPGT

SEQ ID NO: 7355 - protein, 33 aa, synthetic construct
  REGION 1..33: note = Synthetic
GSAPTTGRAGEAANLTPAPLTEGATSGSETPGT

SEQ ID NO: 7356 - protein, 33 aa, synthetic construct
  REGION 1..33: note = Synthetic
GSAPTTGRAGEAANLTPEPLTEGATSGSETPGT

SEQ ID NO: 7357 - protein, 33 aa, synthetic construct; identical to SEQ ID NO: 7280
  REGION 1..33: note = Synthetic

SEQ ID NO: 7358 - protein, 30 aa, synthetic construct
  REGION 1..30: note = Synthetic
GSAPEAGRSAEATSAGATGPATSGSETPGT

SEQ ID NO: 7359 - protein, 30 aa, synthetic construct
  REGION 1..30: note = Synthetic
GSAPSASGTYSRGESGPGSPATSGSETPGT

SEQ ID NO: 7360 - protein, 30 aa, synthetic construct
  REGION 1..30: note = Synthetic
GSAPSASGEAGRTDTHPGSPATSGSETPGT

SEQ ID NO: 7361 - protein, 30 aa, synthetic construct
  REGION 1..30: note = Synthetic
GSAPSASGEPGRAAEHPGSPATSGSETPGT

SEQ ID NO: 7362 - protein, 30 aa, synthetic construct
  REGION 1..30: note = Synthetic
GSAPSPAGESSRGTTIAGSPATSGSETPGT

SEQ ID NO: 7363 - protein, 33 aa, synthetic construct; identical to SEQ ID NO: 7282
  REGION 1..33: note = Synthetic

SEQ ID NO: 7364 - protein, 30 aa, synthetic construct
  REGION 1..30: note = Synthetic
GSAPEAGESAGATPAGLTGPATSGSETPGT

SEQ ID NO: 7365 - protein, 30 aa, synthetic construct
  REGION 1..30: note = Synthetic
GSAPSASGAPLELEAGPGSPATSGSETPGT

SEQ ID NO: 7366 - protein, 30 aa, synthetic construct
  REGION 1..30: note = Synthetic
GSAPSASGEPPELGAGPGSPATSGSETPGT

SEQ ID NO: 7367 - protein, 30 aa, synthetic construct
  REGION 1..30: note = Synthetic
GSAPSASGEPSGLTEGPGSPATSGSETPGT

SEQ ID NO: 7368 - protein, 30 aa, synthetic construct
  REGION 1..30: note = Synthetic
GSAPSASGTPAPLTEPPGSPATSGSETPGT

SEQ ID NO: 7369 - protein, 30 aa, synthetic construct
  REGION 1..30: note = Synthetic
GSAPSASGTPAELTEPPGSPATSGSETPGT

SEQ ID NO: 7370 - protein, 30 aa, synthetic construct
  REGION 1..30: note = Synthetic
GSAPSASGPPPGLTGPPGSPATSGSETPGT

SEQ ID NO: 7371 - protein, 30 aa, synthetic construct
  REGION 1..30: note = Synthetic
GSAPSASGTPAPLGGEPGSPATSGSETPGT

SEQ ID NO: 7372 - protein, 30 aa, synthetic construct
  REGION 1..30: note = Synthetic
GSAPSPAGAPEGLTGPAGSPATSGSETPGT

SEQ ID NO: 7373 - protein, 30 aa, synthetic construct
  REGION 1..30: note = Synthetic
GSAPSPAGPPEGLETEAGSPATSGSETPGT

SEQ ID NO: 7374 - protein, 30 aa, synthetic construct
  REGION 1..30: note = Synthetic
GSAPSPTSGQGGLTGPGSEPATSGSETPGT

SEQ ID NO: 7375 - protein, 30 aa, synthetic construct
  REGION 1..30: note = Synthetic
GSAPSESAPPEGLETESTEPATSGSETPGT

SEQ ID NO: 7376 - protein, 30 aa, synthetic construct
  REGION 1..30: note = Synthetic
GSAPSEGSEPLELGAASETPATSGSETPGT

SEQ ID NO: 7377 - protein, 30 aa, synthetic construct
  REGION 1..30: note = Synthetic
GSAPSEGSGPAGLEAPSETPATSGSETPGT

SEQ ID NO: 7378 - protein, 30 aa, synthetic construct
  REGION 1..30: note = Synthetic
GSAPSEPTPPASLEAEPGSPATSGSETPGT

SEQ ID NO: 7379 - protein, 29 aa, synthetic construct
  REGION 1..29: note = Synthetic
GTAEAASASGGSAGGYAELRMGGAIPGSP

SEQ ID NO: 7380 - protein, 29 aa, synthetic construct
  REGION 1..29: note = Synthetic
GTAEAASASGGTGGGYAPLRMGGGAPGSP

SEQ ID NO: 7381 - protein, 29 aa, synthetic construct
  REGION 1..29: note = Synthetic
GTAEAASASGGAEGGYAALRMGGEIPGSP

SEQ ID NO: 7382 - protein, 29 aa, synthetic construct
  REGION 1..29: note = Synthetic
GTAEAASASGGGPGGYALLRMGGPAPGSP

SEQ ID NO: 7383 - protein, 29 aa, synthetic construct
  REGION 1..29: note = Synthetic
GTAEAASASGGEAGGYAFLRMGGSIPGSP

SEQ ID NO: 7384 - protein, 29 aa, synthetic construct
  REGION 1..29: note = Synthetic
GTAEAASASGGPGGGYASLRMGGTAPGSP

SEQ ID NO: 7385 - protein, 29 aa, synthetic construct
  REGION 1..29: note = Synthetic
GTAEAASASGGSEGGYATLRMGGAIPGSP

SEQ ID NO: 7386 - protein, 29 aa, synthetic construct
  REGION 1..29: note = Synthetic
GTAEAASASGGTPGGYANLRMGGGAPGSP

SEQ ID NO: 7387 - protein, 29 aa, synthetic construct
  REGION 1..29: note = Synthetic
GTAEAASASGGASGGYAHLRMGGEIPGSP

SEQ ID NO: 7388 - protein, 29 aa, synthetic construct
  REGION 1..29: note = Synthetic
GTAEAASASGGGTGGYGELRMGGPAPGSP

SEQ ID NO: 7389 - protein, 29 aa, synthetic construct
  REGION 1..29: note = Synthetic
GTAEAASASGGEAGGYPELRMGGSIPGSP

SEQ ID NO: 7390 - protein, 29 aa, synthetic construct
  REGION 1..29: note = Synthetic
GTAEAASASGGPGGGYVELRMGGTAPGSP

SEQ ID NO: 7391 - protein, 29 aa, synthetic construct
  REGION 1..29: note = Synthetic
GTAEAASASGGSEGGYLELRMGGAIPGSP

SEQ ID NO: 7392 - protein, 29 aa, synthetic construct
  REGION 1..29: note = Synthetic
GTAEAASASGGTPGGYSELRMGGGAPGSP

SEQ ID NO: 7393 - protein, 29 aa, synthetic construct
  REGION 1..29: note = Synthetic
GTAEAASASGGASGGYTELRMGGEIPGSP

SEQ ID NO: 7394 - protein, 29 aa, synthetic construct
  REGION 1..29: note = Synthetic
GTAEAASASGGGTGGYQELRMGGPAPGSP

SEQ ID NO: 7395 - protein, 29 aa, synthetic construct
  REGION 1..29: note = Synthetic
GTAEAASASGGEAGGYEELRMGGSIPGSP

SEQ ID NO: 7396 - protein, 29 aa, synthetic construct
  REGION 1..29: note = Synthetic
GTAEAASASGGPGIGPAELRMGGTAPGSP

SEQ ID NO: 7397 - protein, 29 aa, synthetic construct
  REGION 1..29: note = Synthetic
GTAEAASASGGSEIGAAELRMGGAIPGSP

SEQ ID NO: 7398 - protein, 29 aa, synthetic construct
  REGION 1..29: note = Synthetic
GTAEAASASGGTPIGSAELRMGGGAPGSP

SEQ ID NO: 7399 - protein, 29 aa, synthetic construct
  REGION 1..29: note = Synthetic
GTAEAASASGGASIGTAELRMGGEIPGSP

SEQ ID NO: 7400 - protein, 29 aa, synthetic construct
  REGION 1..29: note = Synthetic
GTAEAASASGGGTIGNAELRMGGPAPGSP

SEQ ID NO: 7401 - protein, 29 aa, synthetic construct
  REGION 1..29: note = Synthetic
GTAEAASASGGEAIGQAELRMGGSIPGSP

SEQ ID NO: 7402 - protein, 29 aa, synthetic construct
  REGION 1..29: note = Synthetic
GTAEAASASGGPGGPYAELRMGGTAPGSP

SEQ ID NO: 7403 - protein, 29 aa, synthetic construct
  REGION 1..29: note = Synthetic
GTAEAASASGGSEGAYAELRMGGAIPGSP

SEQ ID NO: 7404 - protein, 29 aa, synthetic construct
  REGION 1..29: note = Synthetic
GTAEAASASGGTPGVYAELRMGGGAPGSP

SEQ ID NO: 7405 - protein, 29 aa, synthetic construct
  REGION 1..29: note = Synthetic
GTAEAASASGGASGLYAELRMGGEIPGSP

SEQ ID NO: 7406 - protein, 29 aa, synthetic construct
  REGION 1..29: note = Synthetic
GTAEAASASGGGTGIYAELRMGGPAPGSP

SEQ ID NO: 7407 - protein, 29 aa, synthetic construct
  REGION 1..29: note = Synthetic
GTAEAASASGGEAGFYAELRMGGSIPGSP

SEQ ID NO: 7408 - protein, 29 aa, synthetic construct
  REGION 1..29: note = Synthetic
GTAEAASASGGPGGYYAELRMGGTAPGSP

SEQ ID NO: 7409 - protein, 29 aa, synthetic construct
  REGION 1..29: note = Synthetic
GTAEAASASGGSEGSYAELRMGGAIPGSP

SEQ ID NO: 7410 - protein, 29 aa, synthetic construct
  REGION 1..29: note = Synthetic
GTAEAASASGGTPGNYAELRMGGGAPGSP

SEQ ID NO: 7411 - protein, 29 aa, synthetic construct
  REGION 1..29: note = Synthetic
GTAEAASASGGASGEYAELRMGGEIPGSP

SEQ ID NO: 7412 - protein, 29 aa, synthetic construct
  REGION 1..29: note = Synthetic
GTAEAASASGGGTGHYAELRMGGPAPGSP

SEQ ID NO: 7413 - protein, 29 aa, synthetic construct
  REGION 1..29: note = Synthetic
GTAEAASASGGEAGGYAEARMGGSIPGSP

SEQ ID NO: 7414 - protein, 29 aa, synthetic construct
  REGION 1..29: note = Synthetic
GTAEAASASGGPGGGYAEVRMGGTAPGSP

SEQ ID NO: 7415 - protein, 29 aa, synthetic construct
  REGION 1..29: note = Synthetic
GTAEAASASGGSEGGYAEIRMGGAIPGSP

SEQ ID NO: 7416 - protein, 29 aa, synthetic construct
  REGION 1..29: note = Synthetic
GTAEAASASGGTPGGYAEFRMGGGAPGSP

SEQ ID NO: 7417 - protein, 29 aa, synthetic construct
  REGION 1..29: note = Synthetic
GTAEAASASGGASGGYAEYRMGGEIPGSP

SEQ ID NO: 7418 - protein, 29 aa, synthetic construct
  REGION 1..29: note = Synthetic
GTAEAASASGGGTGGYAESRMGGPAPGSP

SEQ ID NO: 7419 - protein, 29 aa, synthetic construct
  REGION 1..29: note = Synthetic
GTAEAASASGGEAGGYAETRMGGSIPGSP

SEQ ID NO: 7420 - protein, 29 aa, synthetic construct
  REGION 1..29: note = Synthetic
GTAEAASASGGPGGGYAELAMGGTRPGSP

SEQ ID NO: 7421 - protein, 29 aa, synthetic construct
  REGION 1..29: note = Synthetic
GTAEAASASGGSEGGYAELVMGGARPGSP

SEQ ID NO: 7422 - protein, 29 aa, synthetic construct
  REGION 1..29: note = Synthetic
GTAEAASASGGTPGGYAELLMGGGRPGSP

SEQ ID NO: 7423 - protein, 29 aa, synthetic construct
  REGION 1..29: note = Synthetic
GTAEAASASGGASGGYAELIMGGERPGSP

SEQ ID NO: 7424 - protein, 29 aa, synthetic construct
  REGION 1..29: note = Synthetic
GTAEAASASGGGTGGYAELWMGGPRPGSP

SEQ ID NO: 7425 - protein, 29 aa, synthetic construct
  REGION 1..29: note = Synthetic
GTAEAASASGGEAGGYAELSMGGSRPGSP

SEQ ID NO: 7426 - protein, 29 aa, synthetic construct
  REGION 1..29: note = Synthetic
GTAEAASASGGPGGGYAELTMGGTRPGSP

SEQ ID NO: 7427 - protein, 29 aa, synthetic construct
  REGION 1..29: note = Synthetic
GTAEAASASGGSEGGYAELQMGGARPGSP

SEQ ID NO: 7428 - protein, 29 aa, synthetic construct
  REGION 1..29: note = Synthetic
GTAEAASASGGTPGGYAELNMGGGRPGSP

SEQ ID NO: 7429 - protein, 29 aa, synthetic construct
  REGION 1..29: note = Synthetic
GTAEAASASGGASGGYAELEMGGERPGSP

SEQ ID NO: 7430 - protein, 29 aa, synthetic construct
  REGION 1..29: note = Synthetic
GTAEAASASGGGTGGYAELRPGGPIPGSP

SEQ ID NO: 7431 - protein, 29 aa, synthetic construct
  REGION 1..29: note = Synthetic
GTAEAASASGGEAGGYAELRAGGSAPGSP

SEQ ID NO: 7432 - protein, 29 aa, synthetic construct
  REGION 1..29: note = Synthetic
GTAEAASASGGPGGGYAELRLGGTIPGSP

SEQ ID NO: 7433 - protein, 29 aa, synthetic construct
  REGION 1..29: note = Synthetic
GTAEAASASGGSEGGYAELRIGGAAPGSP

SEQ ID NO: 7434 - protein, 29 aa, synthetic construct
  REGION 1..29: note = Synthetic
GTAEAASASGGTPGGYAELRSGGGIPGSP

SEQ ID NO: 7435 - protein, 29 aa, synthetic construct
  REGION 1..29: note = Synthetic
GTAEAASASGGASGGYAELRNGGEAPGSP

SEQ ID NO: 7436 - protein, 29 aa, synthetic construct
  REGION 1..29: note = Synthetic
GTAEAASASGGGTGGYAELRQGGPIPGSP

SEQ ID NO: 7437 - protein, 29 aa, synthetic construct
  REGION 1..29: note = Synthetic
GTAEAASASGGEAGGYAELRDGGSAPGSP

SEQ ID NO: 7438 - protein, 29 aa, synthetic construct
  REGION 1..29: note = Synthetic
GTAEAASASGGPGGGYAELREGGTIPGSP

SEQ ID NO: 7439 - protein, 29 aa, synthetic construct
  REGION 1..29: note = Synthetic
GTAEAASASGGSEGGYAELRHGGAAPGSP

SEQ ID NO: 7440 - protein, 29 aa, synthetic construct
  REGION 1..29: note = Synthetic
GTAEAASASGGTPGGYAELRMPGGIPGSP

SEQ ID NO: 7441 - protein, 29 aa, synthetic construct
  REGION 1..29: note = Synthetic
GTAEAASASGGASGGYAELRMAGEAPGSP

SEQ ID NO: 7442 - protein, 29 aa, synthetic construct
  REGION 1..29: note = Synthetic
GTAEAASASGGGTGGYAELRMVGPIPGSP

SEQ ID NO: 7443 - protein, 29 aa, synthetic construct
  REGION 1..29: note = Synthetic
GTAEAASASGGEAGGYAELRMLGSAPGSP

SEQ ID NO: 7444 - protein, 29 aa, synthetic construct
  REGION 1..29: note = Synthetic
GTAEAASASGGPGGGYAELRMIGTIPGSP

SEQ ID NO: 7445 - protein, 29 aa, synthetic construct
  REGION 1..29: note = Synthetic
GTAEAASASGGSEGGYAELRMYGAIPGSP

SEQ ID NO: 7446 - protein, 29 aa, synthetic construct
  REGION 1..29: note = Synthetic
GTAEAASASGGTPGGYAELRMSGGAPGSP

SEQ ID NO: 7447 - protein, 29 aa, synthetic construct
  REGION 1..29: note = Synthetic
GTAEAASASGGASGGYAELRMNGEIPGSP

SEQ ID NO: 7448 - protein, 29 aa, synthetic construct
  REGION 1..29: note = Synthetic
GTAEAASASGGGTGGYAELRMQGPAPGSP

SEQ ID NO: 7449 - protein, 29 aa, synthetic construct
  REGION 1..29: note = Synthetic
GTAEAASASGGANHTPAGLTGPGARPGSP

SEQ ID NO: 7450 - protein, 29 aa, synthetic construct
  REGION 1..29: note = Synthetic
GTAEAASASGGANTAPEGLTGPSTRPGSP

SEQ ID NO: 7451 - protein, 29 aa, synthetic construct
  REGION 1..29: note = Synthetic
GTAEAASASGGTGAPPGGLTGPGTRPGSP

SEQ ID NO: 7452 - protein, 29 aa, synthetic construct
  REGION 1..29: note = Synthetic
GTAEAASASGGANHEPSGLTEGSPRPGSP

SEQ ID NO: 7453 - protein, 29 aa, synthetic construct
  REGION 1..29: note = Synthetic
GTAEAASASGGANTEPPELGAGTERPGSP

SEQ ID NO: 7454 - protein, 29 aa, synthetic construct
  REGION 1..29: note = Synthetic
GTAEAASASGGASGPPPGLTGPPGRPGSP

SEQ ID NO: 7455 - protein, 29 aa, synthetic construct
  REGION 1..29: note = Synthetic
GTAEAASASGGASGTPAPLGGEPGRPGSP

SEQ ID NO: 7456 - protein, 29 aa, synthetic construct
  REGION 1..29: note = Synthetic
GTAEAASASGGPAGPPEGLETEAGRPGSP

SEQ ID NO: 7457 - protein, 29 aa, synthetic construct
  REGION 1..29: note = Synthetic
GTAEAASASGGPTSGQGGLTGPESRPGSP

SEQ ID NO: 7458 - protein, 29 aa, synthetic construct
  REGION 1..29: note = Synthetic
GTAEAASASGGSAGGAANLVRGGAIPGSP

SEQ ID NO: 7459 - protein, 29 aa, synthetic construct
  REGION 1..29: note = Synthetic
GTAEAASASGGTGGGAAPLVRGGGAPGSP

SEQ ID NO: 7460 - protein, 29 aa, synthetic construct
  REGION 1..29: note = Synthetic
GTAEAASASGGAEGGAAALVRGGEIPGSP

SEQ ID NO: 7461 - protein, 29 aa, synthetic construct
  REGION 1..29: note = Synthetic
GTAEAASASGGGPGGAALLVRGGPAPGSP

SEQ ID NO: 7462 - protein, 29 aa, synthetic construct
  REGION 1..29: note = Synthetic
GTAEAASASGGEAGGAAFLVRGGSIPGSP

SEQ ID NO: 7463 - protein, 29 aa, synthetic construct
  REGION 1..29: note = Synthetic
GTAEAASASGGPGGGAASLVRGGTAPGSP

SEQ ID NO: 7464 - protein, 29 aa, synthetic construct
  REGION 1..29: note = Synthetic
GTAEAASASGGSEGGAATLVRGGAIPGSP

SEQ ID NO: 7465 - protein, 29 aa, synthetic construct
  REGION 1..29: note = Synthetic
GTAEAASASGGTPGGAAGLVRGGGAPGSP

SEQ ID NO: 7466 - protein, 29 aa, synthetic construct
  REGION 1..29: note = Synthetic
GTAEAASASGGASGGAADLVRGGEIPGSP

SEQ ID NO: 7467 - protein, 29 aa, synthetic construct
  REGION 1..29: note = Synthetic
GTAEAASASGGGTGGAGNLVRGGPAPGSP

SEQ ID NO: 7468 - protein, 29 aa, synthetic construct
  REGION 1..29: note = Synthetic
GTAEAASASGGEAGGAPNLVRGGSIPGSP

SEQ ID NO: 7469 - protein, 29 aa, synthetic construct
  REGION 1..29: note = Synthetic
GTAEAASASGGPGGGAVNLVRGGTAPGSP

SEQ ID NO: 7470 - protein, 29 aa, synthetic construct
  REGION 1..29: note = Synthetic
GTAEAASASGGSEGGALNLVRGGAIPGSP

SEQ ID NO: 7471 - protein, 29 aa, synthetic construct
  REGION 1..29: note = Synthetic
GTAEAASASGGTPGGASNLVRGGGAPGSP

SEQ ID NO: 7472 - protein, 29 aa, synthetic construct
  REGION 1..29: note = Synthetic
GTAEAASASGGASGGATNLVRGGEIPGSP

SEQ ID NO: 7473 - protein, 29 aa, synthetic construct
  REGION 1..29: note = Synthetic
GTAEAASASGGGTGGAQNLVRGGPAPGSP

SEQ ID NO: 7474 - protein, 29 aa, synthetic construct
  REGION 1..29: note = Synthetic
GTAEAASASGGEAGGAENLVRGGSIPGSP

SEQ ID NO: 7475 - protein, 30 aa, synthetic construct
  REGION 1..30: note = Synthetic
GTAEAASASGEAGRSANHEPLGLVATPGSP

SEQ ID NO: 7476 - protein, 30 aa, synthetic construct
  REGION 1..30: note = Synthetic
GTAEAASASGASGRSTNAGPSGLAGPPGSP

SEQ ID NO: 7477 - protein, 30 aa, synthetic construct
  REGION 1..30: note = Synthetic
GTAEAASASGASGRSTNAGPQGLAGQPGSP

SEQ ID NO: 7478 - protein, 30 aa, synthetic construct
  REGION 1..30: note = Synthetic
GTAEAASASGASGRSTNAGPPGLTGPPGSP

SEQ ID NO: 7479 - protein, 30 aa, synthetic construct
  REGION 1..30: note = Synthetic
GTAEAASASGASSRGTNAGPAGLTGPPGSP

SEQ ID NO: 7480 - protein, 30 aa, synthetic construct
  REGION 1..30: note = Synthetic
GTAEAASASGASSRTTNTGPSTLTGPPGSP

SEQ ID NO: 7481 - protein, 30 aa, synthetic construct
  REGION 1..30: note = Synthetic
GTAEAASASGAAGRSDNGTPLELVAPPGSP

SEQ ID NO: 7482 - protein, 30 aa, synthetic construct; identical to SEQ ID NO: 7475
  REGION 1..30: note = Synthetic

SEQ ID NO: 7483 - protein, 30 aa, synthetic construct
  REGION 1..30: note = Synthetic
GTAEAASASGASGRGTNAGPAGLTGPPGSP

SEQ ID NO: 7484 - protein, 30 aa, synthetic construct
  REGION 1..30: note = Synthetic
GTAEAASASGLFGRNDNHEPLELGGGPGSP

SEQ ID NO: 7485 - protein, 30 aa, synthetic construct
  REGION 1..30: note = Synthetic
GTAEAASASGTAGRSDNLEPLGLVFGPGSP

SEQ ID NO: 7486 - protein, 30 aa, synthetic construct
  REGION 1..30: note = Synthetic
GTAEAASASGLDGRSDNFHPPELVAGPGSP

SEQ ID NO: 7487 - protein, 30 aa, synthetic construct
  REGION 1..30: note = Synthetic
GTAEAASASGLEGRSDNEEPENLVAGPGSP

SEQ ID NO: 7488 - protein, 30 aa, synthetic construct
  REGION 1..30: note = Synthetic
GTAEAASASGLKGRSDNNAPLALVAGPGSP

SEQ ID NO: 7489 - protein, 30 aa, synthetic construct
  REGION 1..30: note = Synthetic
GTAEAASASGVYSRGTNAGPHGLTGRPGSP

SEQ ID NO: 7490 - protein, 30 aa, synthetic construct
  REGION 1..30: note = Synthetic
GTAEAASASGANSRGTNKGFAGLIGPPGSP

SEQ ID NO: 7491 - protein, 30 aa, synthetic construct
  REGION 1..30: note = Synthetic
GTAEAASASGASSRLTNEAPAGLTIPPGSP

SEQ ID NO: 7492 - protein, 30 aa, synthetic construct
  REGION 1..30: note = Synthetic
GTAEAASASGDQSRGTNAGPEGLTDPPGSP

SEQ ID NO: 7493 - protein, 30 aa, synthetic construct
  REGION 1..30: note = Synthetic
GTAEAASASGESSRGTNIGQGGLTGPPGSP

SEQ ID NO: 7494 - protein, 30 aa, synthetic construct
  REGION 1..30: note = Synthetic
GTAEAASASGSSSRGTNQDPAGLTIPPGSP

SEQ ID NO: 7495 - protein, 30 aa, synthetic construct
  REGION 1..30: note = Synthetic
GTAEAASASGASSRGQNHSPMGLTGPPGSP

SEQ ID NO: 7496 - protein, 30 aa, synthetic construct
  REGION 1..30: note = Synthetic
GTAEAASASGAYSRGPNAGPAGLEGRPGSP

SEQ ID NO: 7497 - protein, 30 aa, synthetic construct
  REGION 1..30: note = Synthetic
GTAEAASASGASERGNNAGPANLTGFPGSP

SEQ ID NO: 7498 - protein, 30 aa, synthetic construct
  REGION 1..30: note = Synthetic
GTAEAASASGASHRGTNPKPAILTGPPGSP

SEQ ID NO: 7499 - protein, 30 aa, synthetic construct
  REGION 1..30: note = Synthetic
GTAEAASASGMSSRRTNANPAQLTGPPGSP

SEQ ID NO: 7500 - protein, 30 aa, synthetic construct
  REGION 1..30: note = Synthetic
GTAEAASASGGAGRTDNHEPLELGAAPGSP

SEQ ID NO: 7501 - protein, 30 aa, synthetic construct
  REGION 1..30: note = Synthetic
GTAEAASASGLAGRSENTAPLELTAGPGSP

SEQ ID NO: 7502 - protein, 30 aa, synthetic construct
  REGION 1..30: note = Synthetic
GTAEAASASGLEGRPDNHEPLALVASPGSP

SEQ ID NO: 7503 - protein, 30 aa, synthetic construct
  REGION 1..30: note = Synthetic
GTAEAASASGLSGRSDNEEPLALPAGPGSP

SEQ ID NO: 7504 - protein, 30 aa, synthetic construct
  REGION 1..30: note = Synthetic
GTAEAASASGEAGRTDNHEPLELSAPPGSP

SEQ ID NO: 7505 - protein, 30 aa, synthetic construct
  REGION 1..30: note = Synthetic
GTAEAASASGEGGRSDNHGPLELVSGPGSP

SEQ ID NO: 7506 - protein, 30 aa, synthetic construct
  REGION 1..30: note = Synthetic
GTAEAASASGLSGRSDNEAPLELEAGPGSP

SEQ ID NO: 7507 - protein, 30 aa, synthetic construct
  REGION 1..30: note = Synthetic
GTAEAASASGLGGRADNHEPPELGAGPGSP

SEQ ID NO: 7508 - protein, 30 aa, synthetic construct
  REGION 1..30: note = Synthetic
GTAEAASASGPPSRGTNAEPAGLTGEPGSP

SEQ ID NO: 7509 - protein, 30 aa, synthetic construct
  REGION 1..30: note = Synthetic
GTAEAASASGASTRGENAGPAGLEAPPGSP

SEQ ID NO: 7510 - protein, 30 aa, synthetic construct
  REGION 1..30: note = Synthetic
GTAEAASASGESSRGTNGAPEGLTGPPGSP

SEQ ID NO: 7511 - protein, 30 aa, synthetic construct
  REGION 1..30: note = Synthetic
GTAEAASASGASSRATNESPAGLTGEPGSP

SEQ ID NO: 7512 - protein, 30 aa, synthetic construct
  REGION 1..30: note = Synthetic
GTAEAASASGASSRGENPPPGGLTGPPGSP

SEQ ID NO: 7513 - protein, 30 aa, synthetic construct
  REGION 1..30: note = Synthetic
GTAEAASASGAASRGTNTGPAELTGSPGSP

SEQ ID NO: 7514 - protein, 30 aa, synthetic construct
  REGION 1..30: note = Synthetic
GTAEAASASGAGSRTTNAGPGGLEGPPGSP

SEQ ID NO: 7515 - protein, 30 aa, synthetic construct
  REGION 1..30: note = Synthetic
GTAEAASASGAPSRGENAGPATLTGAPGSP

SEQ ID NO: 7516 - protein, 30 aa, synthetic construct
  REGION 1..30: note = Synthetic
GTAEAASASGESGRAANTGPPTLTAPPGSP

SEQ ID NO: 7517 - protein, 30 aa, synthetic construct
  REGION 1..30: note = Synthetic
GTAEAASASGNPGRAANEGPPGLPGSPGSP

SEQ ID NO: 7518 - protein, 30 aa, synthetic construct
  REGION 1..30: note = Synthetic
GTAEAASASGESSRAANLTPPELTGPPGSP

SEQ ID NO: 7519 - protein, 30 aa, synthetic construct
  REGION 1..30: note = Synthetic
GTAEAASASGASGRAANETPPGLTGAPGSP

SEQ ID NO: 7520 - protein, 30 aa, synthetic construct
  REGION 1..30: note = Synthetic
GTAEAASASGNSGRGENLGAPGLTGTPGSP

SEQ ID NO: 7521 - protein, 30 aa, synthetic construct
  REGION 1..30: note = Synthetic
GTAEAASASGTTGRAANLTPAGLTGPPGSP

SEQ ID NO: 7522 - protein, 30 aa, synthetic construct
  REGION 1..30: note = Synthetic
GTAEAASASGEAGRSANHTPAGLTGPPGSP

SEQ ID NO: 7523 - protein, 30 aa, synthetic construct
  REGION 1..30: note = Synthetic
GTAEAASASGESGRAANTTPAGLTGPPGSP

SEQ ID NO: 7524 - protein, 33 aa, synthetic construct
  REGION 1..33: note = Synthetic
GTAEAASASGTTGRATEAANLTPAGLTGPPGSP

SEQ ID NO: 7525 - protein, 33 aa, synthetic construct
  REGION 1..33: note = Synthetic
GTAEAASASGTTGRAEEAANLTPAGLTGPPGSP

SEQ ID NO: 7526 - protein, 33 aa, synthetic construct
  REGION 1..33: note = Synthetic
GTAEAASASGTTGRAGEAANLTPAGLTGPPGSP

SEQ ID NO: 7527 - protein, 33 aa, synthetic construct
  REGION 1..33: note = Synthetic
GTAEAASASGTTGRATEAANATPAGLTGPPGSP

SEQ ID NO: 7528 - protein, 33 aa, synthetic construct
  REGION 1..33: note = Synthetic
GTAEAASASGTTGRAGEAEGATSAGATGPPGSP

SEQ ID NO: 7529 - protein, 33 aa, synthetic construct
  REGION 1..33: note = Synthetic
GTAEAASASGTTGEAGEAANATSAGATGPPGSP

SEQ ID NO: 7530 - protein, 33 aa, synthetic construct
  REGION 1..33: note = Synthetic
GTAEAASASGTTGEAGEAAGLTPAGLTGPPGSP

SEQ ID NO: 7531 - protein, 33 aa, synthetic construct
  REGION 1..33: note = Synthetic
GTAEAASASGTTGAAGEAANATPAGLTGPPGSP

SEQ ID NO: 7532 - protein, 33 aa, synthetic construct
  REGION 1..33: note = Synthetic
GTAEAASASGTTGRAGEAAGLTPAGLTGPPGSP

SEQ ID NO: 7533 - protein, 33 aa, synthetic construct
  REGION 1..33: note = Synthetic
GTAEAASASGTTGRAGEAANATSAGATGPPGSP

SEQ ID NO: 7534 - protein, 33 aa, synthetic construct
  REGION 1..33: note = Synthetic
GTAEAASASGTTGEAGEAAGATSAGATGPPGSP

SEQ ID NO: 7535 - protein, 30 aa, synthetic construct
  REGION 1..30: note = Synthetic
GTAEAASASGESGRAANTEPPELGAGPGSP

SEQ ID NO: 7536 - protein, 30 aa, synthetic construct
  REGION 1..30: note = Synthetic
GTAEAASASGESGRAANTAPEGLTGPPGSP

SEQ ID NO: 7537 - protein, 30 aa, synthetic construct
  REGION 1..30: note = Synthetic
GTAEAASASGEPGRAANHEPSGLTEGPGSP

SEQ ID NO: 7538 - protein, 33 aa, synthetic construct
  REGION 1..33: note = Synthetic
GTAEAASASGESGRAANHTGAPPGGLTGPPGSP

SEQ ID NO: 7539 - protein, 33 aa, synthetic construct
  REGION 1..33: note = Synthetic
GTAEAASASGTTGRTGEGANATPGGLTGPPGSP

SEQ ID NO: 7540 - protein, 33 aa, synthetic construct
  REGION 1..33: note = Synthetic
GTAEAASASGRTGRSGEAANETPEGLEGPPGSP

SEQ ID NO: 7541 - protein, 33 aa, synthetic construct
  REGION 1..33: note = Synthetic
GTAEAASASGRTGRTGESANETPAGLGGPPGSP

SEQ ID NO: 7542 - protein, 33 aa, synthetic construct
  REGION 1..33: note = Synthetic
GTAEAASASGSTGRTGEPANETPAGLSGPPGSP

SEQ ID NO: 7543 - protein, 33 aa, synthetic construct
  REGION 1..33: note = Synthetic
GTAEAASASGTTGRAGEPANATPTGLSGPPGSP

SEQ ID NO: 7544 - protein, 33 aa, synthetic construct
  REGION 1..33: note = Synthetic
GTAEAASASGRTGRPGEGANATPTGLPGPPGSP

SEQ ID NO: 7545 - protein, 33 aa, synthetic construct
  REGION 1..33: note = Synthetic
GTAEAASASGRTGRGGEAANATPSGLGGPPGSP

SEQ ID NO: 7546 - protein, 33 aa, synthetic construct
  REGION 1..33: note = Synthetic
GTAEAASASGSTGRSGESANATPGGLGGPPGSP

SEQ ID NO: 7547 - protein, 33 aa, synthetic construct
  REGION 1..33: note = Synthetic
GTAEAASASGRTGRTGEEANATPAGLPGPPGSP

SEQ ID NO: 7548 - protein, 33 aa, synthetic construct
  REGION 1..33: note = Synthetic
GTAEAASASGATGRPGEPANTTPEGLEGPPGSP

SEQ ID NO: 7549 - protein, 33 aa, synthetic construct
  REGION 1..33: note = Synthetic
GTAEAASASGSTGRSGEPANATPGGLTGPPGSP

SEQ ID NO: 7550 - protein, 33 aa, synthetic construct
  REGION 1..33: note = Synthetic
GTAEAASASGPTGRGGEGANTTPTGLPGPPGSP

SEQ ID NO: 7551 - protein, 33 aa, synthetic construct
  REGION 1..33: note = Synthetic
GTAEAASASGPTGRSGEGANATPSGLTGPPGSP

SEQ ID NO: 7552 - protein, 33 aa, synthetic construct
  REGION 1..33: note = Synthetic
GTAEAASASGTTGRASEGANSTPAPLTEPPGSP

SEQ ID NO: 7553 - protein, 33 aa, synthetic construct
  REGION 1..33: note = Synthetic
GTAEAASASGTYGRAAEAANTTPAGLTAPPGSP

SEQ ID NO: 7554 - protein, 33 aa, synthetic construct
  REGION 1..33: note = Synthetic
GTAEAASASGTTGRATEGANATPAELTEPPGSP

SEQ ID NO: 7555 - protein, 33 aa, synthetic construct
  REGION 1..33: note = Synthetic
GTAEAASASGTVGRASEEANTTPASLTGPPGSP

SEQ ID NO: 7556 - protein, 33 aa, synthetic construct
  REGION 1..33: note = Synthetic
GTAEAASASGTTGRAPEAANATPAPLTGPPGSP

SEQ ID NO: 7557 - protein, 33 aa, synthetic construct
  REGION 1..33: note = Synthetic
GTAEAASASGTWGRATEPANATPAPLTSPPGSP

SEQ ID NO: 7558 - protein, 33 aa, synthetic construct
  REGION 1..33: note = Synthetic
GTAEAASASGTVGRASESANATPAELTSPPGSP

SEQ ID NO: 7559 - protein, 33 aa, synthetic construct
  REGION 1..33: note = Synthetic
GTAEAASASGTVGRAPEGANSTPAGLTGPPGSP

SEQ ID NO: 7560 - protein, 33 aa, synthetic construct
  REGION 1..33: note = Synthetic
GTAEAASASGTWGRATEAPNLEPATLTTPPGSP

SEQ ID NO: 7561 - protein, 33 aa, synthetic construct
  REGION 1..33: note = Synthetic
GTAEAASASGTTGRATEAPNLTPAPLTEPPGSP

SEQ ID NO: 7562 - protein, 33 aa, synthetic construct
  REGION 1..33: note = Synthetic
GTAEAASASGTQGRATEAPNLSPAALTSPPGSP

SEQ ID NO: 7563 - protein, 33 aa, synthetic construct
  REGION 1..33: note = Synthetic
GTAEAASASGTQGRAAEAPNLTPATLTAPPGSP

SEQ ID NO: 7564 - protein, 33 aa, synthetic construct
  REGION 1..33: note = Synthetic
GTAEAASASGTSGRAPEATNLAPAPLTGPPGSP

SEQ ID NO: 7565 - protein, 33 aa, synthetic construct
  REGION 1..33: note = Synthetic
GTAEAASASGTQGRAAEAANLTPAGLTEPPGSP

SEQ ID NO: 7566 - protein, 33 aa, synthetic construct
  REGION 1..33: note = Synthetic
GTAEAASASGTTGRAGSAPNLPPTGLTTPPGSP

SEQ ID NO: 7567 - protein, 33 aa, synthetic construct
  REGION 1..33: note = Synthetic
GTAEAASASGTTGRAGGAENLPPEGLTAPPGSP

SEQ ID NO: 7568 - protein, 33 aa, synthetic construct
  REGION 1..33: note = Synthetic
GTAEAASASGTTSRAGTATNLTPEGLTAPPGSP

SEQ ID NO: 7569 - protein, 33 aa, synthetic construct
  REGION 1..33: note = Synthetic
GTAEAASASGTTGRAGTATNLPPSGLTTPPGSP

SEQ ID NO: 7570 - protein, 33 aa, synthetic construct
  REGION 1..33: note = Synthetic
GTAEAASASGTTARAGEAENLSPSGLTAPPGSP

SEQ ID NO: 7571 - protein, 33 aa, synthetic construct
  REGION 1..33: note = Synthetic
GTAEAASASGTTGRAGGAGNLAPGGLTEPPGSP

SEQ ID NO: 7572 - protein, 33 aa, synthetic construct
  REGION 1..33: note = Synthetic
GTAEAASASGTTGRAGTATNLPPEGLTGPPGSP

SEQ ID NO: 7573 - protein, 33 aa, synthetic construct
  REGION 1..33: note = Synthetic
GTAEAASASGTTGRAGGAANLAPTGLTEPPGSP

SEQ ID NO: 7574 - protein, 33 aa, synthetic construct
  REGION 1..33: note = Synthetic
GTAEAASASGTTGRAGTAENLAPSGLTTPPGSP

SEQ ID NO: 7575 - protein, 33 aa, synthetic construct
  REGION 1..33: note = Synthetic
GTAEAASASGTTGRAGSATNLGPGGLTGPPGSP

SEQ ID NO: 7576 - protein, 33 aa, synthetic construct
  REGION 1..33: note = Synthetic
GTAEAASASGTTARAGGAENLTPAGLTEPPGSP

SEQ ID NO: 7577 - protein, 33 aa, synthetic construct
  REGION 1..33: note = Synthetic
GTAEAASASGTTARAGSAENLSPSGLTGPPGSP

SEQ ID NO: 7578 - protein, 33 aa, synthetic construct
  REGION 1..33: note = Synthetic
GTAEAASASGTTARAGGAGNLAPEGLTTPPGSP

SEQ ID NO: 7579 - protein, 33 aa, synthetic construct
  REGION 1..33: note = Synthetic
GTAEAASASGTTSRAGAAENLTPTGLTGPPGSP

SEQ ID NO: 7580 - protein, 33 aa, synthetic construct
  REGION 1..33: note = Synthetic
GTAEAASASGTYGRTTTPGNEPPASLEAEPGSP

SEQ ID NO: 7581 - protein, 33 aa, synthetic construct
  REGION 1..33: note = Synthetic
GTAEAASASGTYSRGESGPNEPPPGLTGPPGSP

SEQ ID NO: 7582 - protein, 33 aa, synthetic construct
  REGION 1..33: note = Synthetic
GTAEAASASGAWGRTGASENETPAPLGGEPGSP

SEQ ID NO: 7583 - protein, 33 aa, synthetic construct
  REGION 1..33: note = Synthetic
GTAEAASASGRWGRAETTPNTPPEGLETEPGSP

SEQ ID NO: 7584 - protein, 33 aa, synthetic construct
  REGION 1..33: note = Synthetic
GTAEAASASGESGRAANHTGAEPPELGAGPGSP

SEQ ID NO: 7585 - protein, 33 aa, synthetic construct
  REGION 1..33: note = Synthetic
GTAEAASASGTTGRAGEAANLTPAGLTESPGSP

SEQ ID NO: 7586 - protein, 33 aa, synthetic construct
  REGION 1..33: note = Synthetic
GTAEAASASGTTGRAGEAANLTPAALTESPGSP

SEQ ID NO: 7587 - protein, 33 aa, synthetic construct
  REGION 1..33: note = Synthetic
GTAEAASASGTTGRAGEAANLTPAPLTESPGSP

SEQ ID NO: 7588 - protein, 33 aa, synthetic construct
  REGION 1..33: note = Synthetic
GTAEAASASGTTGRAGEAANLTPEPLTESPGSP

SEQ ID NO: 7589 - protein, 33 aa, synthetic construct
  REGION 1..33: note = Synthetic
GTAEAASASGTTGRAGEAANLTPAGLTGAPGSP

SEQ ID NO: 7590 - protein, 33 aa, synthetic construct
  REGION 1..33: note = Synthetic
GTAEAASASGTTGRAGEAANLTPEGLTGAPGSP

SEQ ID NO: 7591 - protein, 33 aa, synthetic construct
  REGION 1..33: note = Synthetic
GTAEAASASGTTGRAGEAANLTPEPLTGAPGSP

SEQ ID NO: 7592 - protein, 33 aa, synthetic construct
  REGION 1..33: note = Synthetic
GTAEAASASGTTGRAGEAANLTPAGLTEAPGSP

SEQ ID NO: 7593 - protein, 33 aa, synthetic construct
  REGION 1..33: note = Synthetic
GTAEAASASGTTGRAGEAANLTPEGLTEAPGSP

SEQ ID NO: 7594 - protein, 33 aa, synthetic construct
  REGION 1..33: note = Synthetic
GTAEAASASGTTGRAGEAANLTPAPLTEAPGSP

SEQ ID NO: 7595 - protein, 33 aa, synthetic construct
  REGION 1..33: note = Synthetic
GTAEAASASGTTGRAGEAANLTPEPLTEAPGSP

SEQ ID NO: 7596 - protein, 33 aa, synthetic construct
  REGION 1..33: note = Synthetic
GTAEAASASGTTGRAGEAANLTPEPLTGPPGSP

SEQ ID NO: 7597 - protein, 33 aa, synthetic construct
  REGION 1..33: note = Synthetic
GTAEAASASGTTGRAGEAANLTPAGLTGGPGSP

SEQ ID NO: 7598 - protein, 33 aa, synthetic construct
  REGION 1..33: note = Synthetic
GTAEAASASGTTGRAGEAANLTPEGLTGGPGSP

SEQ ID NO: 7599 - protein, 33 aa, synthetic construct
  REGION 1..33: note = Synthetic
GTAEAASASGTTGRAGEAANLTPEALTGGPGSP

SEQ ID NO: 7600 - protein, 33 aa, synthetic construct
  REGION 1..33: note = Synthetic
GTAEAASASGTTGRAGEAANLTPEPLTGGPGSP

SEQ ID NO: 7601 - protein, 33 aa, synthetic construct
  REGION 1..33: note = Synthetic
GTAEAASASGTTGRAGEAANLTPAGLTEGPGSP

SEQ ID NO: 7602 - protein, 33 aa, synthetic construct
  REGION 1..33: note = Synthetic
GTAEAASASGTTGRAGEAANLTPEGLTEGPGSP

SEQ ID NO: 7603 - protein, 33 aa, synthetic construct
  REGION 1..33: note = Synthetic
GTAEAASASGTTGRAGEAANLTPAPLTEGPGSP

SEQ ID NO: 7604 - protein, 33 aa, synthetic construct
  REGION 1..33: note = Synthetic
GTAEAASASGTTGRAGEAANLTPEPLTEGPGSP

SEQ ID NO: 7605 - protein, 33 aa, synthetic construct; identical to SEQ ID NO: 7528
  REGION 1..33: note = Synthetic

SEQ ID NO: 7606 - protein, 30 aa, synthetic construct
  REGION 1..30: note = Synthetic
GTAEAASASGEAGRSAEATSAGATGPPGSP

SEQ ID NO: 7607 - protein, 30 aa, synthetic construct
  REGION 1..30: note = Synthetic
GTAEAASASGSASGTYSRGESGPGSPPGSP

SEQ ID NO: 7608 - protein, 30 aa, synthetic construct
  REGION 1..30: note = Synthetic
GTAEAASASGSASGEAGRTDTHPGSPPGSP

SEQ ID NO: 7609 - protein, 30 aa, synthetic construct
  REGION 1..30: note = Synthetic
GTAEAASASGSASGEPGRAAEHPGSPPGSP

SEQ ID NO: 7610 - protein, 30 aa, synthetic construct
  REGION 1..30: note = Synthetic
GTAEAASASGSPAGESSRGTTIAGSPPGSP

SEQ ID NO: 7611 - protein, 33 aa, synthetic construct; identical to SEQ ID NO: 7530
  REGION 1..33: note = Synthetic

SEQ ID NO: 7612 - protein, 30 aa, synthetic construct
  REGION 1..30: note = Synthetic
GTAEAASASGEAGESAGATPAGLTGPPGSP

SEQ ID NO: 7613 - protein, 30 aa, synthetic construct
  REGION 1..30: note = Synthetic
GTAEAASASGSASGAPLELEAGPGSPPGSP

SEQ ID NO: 7614 - protein, 30 aa, synthetic construct
  REGION 1..30: note = Synthetic
GTAEAASASGSASGEPPELGAGPGSPPGSP

SEQ ID NO: 7615 - protein, 30 aa, synthetic construct
  REGION 1..30: note = Synthetic
GTAEAASASGSASGEPSGLTEGPGSPPGSP

SEQ ID NO: 7616 - protein, 30 aa, synthetic construct
  REGION 1..30: note = Synthetic
GTAEAASASGSASGTPAPLTEPPGSPPGSP

SEQ ID NO: 7617 - protein, 30 aa, synthetic construct
  REGION 1..30: note = Synthetic
GTAEAASASGSASGTPAELTEPPGSPPGSP

SEQ ID NO: 7618 - protein, 30 aa, synthetic construct
  REGION 1..30: note = Synthetic
GTAEAASASGSASGPPPGLTGPPGSPPGSP

SEQ ID NO: 7619 - protein, 30 aa, synthetic construct
  REGION 1..30: note = Synthetic
GTAEAASASGSASGTPAPLGGEPGSPPGSP

SEQ ID NO: 7620 - protein, 30 aa, synthetic construct
  REGION 1..30: note = Synthetic
GTAEAASASGSPAGAPEGLTGPAGSPPGSP

SEQ ID NO: 7621 - protein, 30 aa, synthetic construct
  REGION 1..30: note = Synthetic
GTAEAASASGSPAGPPEGLETEAGSPPGSP

SEQ ID NO: 7622 - protein, 30 aa, synthetic construct
  REGION 1..30: note = Synthetic
GTAEAASASGSPTSGQGGLTGPGSEPPGSP

SEQ ID NO: 7623 - protein, 30 aa, synthetic construct
  REGION 1..30: note = Synthetic
GTAEAASASGSESAPPEGLETESTEPPGSP

SEQ ID NO: 7624 - protein, 30 aa, synthetic construct
  REGION 1..30: note = Synthetic
GTAEAASASGSEGSEPLELGAASETPPGSP

SEQ ID NO: 7625 - protein, 30 aa, synthetic construct
  REGION 1..30: note = Synthetic
GTAEAASASGSEGSGPAGLEAPSETPPGSP

SEQ ID NO: 7626 - protein, 30 aa, synthetic construct
  REGION 1..30: note = Synthetic
GTAEAASASGSEPTPPASLEAEPGSPPGSP

SEQ ID NO: 7627-8000 - skipped (374 entries)

SEQ ID NO: 8001 - protein, 874 aa, synthetic construct
  REGION 1..874: note = Synthetic
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGFTABTSESATPESGPGSEPATSGPTESGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 8002 - protein, 870 aa, synthetic construct
  REGION 1..870: note = Synthetic
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGPTESGSEPATSGSETPGSPAGSPTSTEEGTSTEPSEGSAPGTSTEPSEGSAPGSEPATSGSETPGTSESATPESGPGTSTEPSEGSAPGEPEA

SEQ ID NO: 8003 - protein, 870 aa, synthetic construct
  REGION 1..870: note = Synthetic
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 8004 - protein, 294 aa, synthetic construct
  REGION 1..294: note = Synthetic
ASSPAGSPTSTESGTSESATPESGPGTETEPSEGSAPGTSESATPESGPGSEPATSGSETPGTSESATPESGPGSTPAESGSETPGTSESATPESGPGTSTEPSEGSAPGSPAGSPTSTEEGTSESATPESGPGESPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8005 - protein, 294 aa, synthetic construct
  REGION 1..294: note = Synthetic
ASSPAGSPTSTESGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGESPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8006 - protein, 294 aa, synthetic construct
  REGION 1..294: note = Synthetic
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGEEPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8007 - protein, 294 aa, synthetic construct
  REGION 1..294: note = Synthetic
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8008 - protein, 866 aa, synthetic construct
  REGION 1..866: note = Synthetic
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPG

SEQ ID NO: 8009 - protein, 578 aa, synthetic construct
  REGION 1..578: note = Synthetic
PGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPG

SEQ ID NO: 8010 - protein, 1152 aa, synthetic construct
  REGION 1..1152: note = Synthetic
SAGSPGSPAGSPTSTEEGTSESATPESGPGTSTEPSEGSAPGSPAGSPTSTEEGTSTEPSEGSAPGTSTEPSEGSAPGTSESATPESGPGSTPAESGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSTETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTESAS

SEQ ID NO: 8011 - protein, 1153 aa, synthetic construct
  REGION 1..1153: note = Synthetic
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSTETPGSPAGSPTSTEEGTSESATPESGPGTSTEPSEGSAPGTSTEPSEGSAPGSPAGSPTSTEEGTSTEPSEGSAPGTATESPEGSAPGTSESATPESGPGTSTEPSEGSAPGTSAESATPESGPGSEPATSGSETPGTSTEPSEGSAPGTSTEPSEGSAPGTSESATPESGPGTESAS

SEQ ID NO: 8012 - protein, 864 aa, synthetic construct
  REGION 1..864: note = Synthetic
GSPAGSPTSTEEGTSESATPESGPGTSTEPSEGSAPGSPAGSPTSTEEGTSTEPSEGSAPGTSTEPSEGSAPATSESATPESGPGSEPATSGSETPGSEPATSGSETPGSPAGSPTSTEEGTSESASPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 8013 - protein, 864 aa, synthetic construct
  REGION 1..864: note = Synthetic
GSPAGSPTSTEEGTSESATPESGPGTSTEPSEGSAPGSPAGSPTSTEEGTSTEPSEGSAPGTSTEPSEGSAPGTSESATPESGPGSESATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 8014 - protein, 292 aa, synthetic construct
  REGION 1..292: note = Synthetic
SPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8015 - protein, 582 aa, synthetic construct
  REGION 1..582: note = Synthetic
PGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 8016 - protein, 576 aa, synthetic construct
  REGION 1..576: note = Synthetic
TPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSESATSGSETPGSPAGSPTSTEEGTSTEPSEGSAPGTSTEPSEGSAPGSEPATSGSETPGTSESA

SEQ ID NO: 8017 - protein, 576 aa, synthetic construct
  REGION 1..576: note = Synthetic
GTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESASPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGP

SEQ ID NO: 8018 - protein, 576 aa, synthetic construct
  REGION 1..576: note = Synthetic
GSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSTETGTSESATPESGPGSEPATSGSETPGTSESATPESGPGTSTEPSEGSAPGSPAGSPTSTEEGTSESATPESGPGSEPATS

SEQ ID NO: 8019 - protein, 576 aa, synthetic construct
  REGION 1..576: note = Synthetic
EGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESASPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESAT

SEQ ID NO: 8020 - protein, 294 aa, synthetic construct; identical to SEQ ID NO: 8007
  REGION 1..294: note = Synthetic

SEQ ID NO: 8021 - protein, 292 aa, synthetic construct; identical to SEQ ID NO: 650
  REGION 1..292: note = Synthetic

SEQ ID NO: 8022 - protein, 584 aa, synthetic construct; identical to SEQ ID NO: 659
  REGION 1..584: note = Synthetic

What is claimed is:

1. A polypeptide comprising the amino acid sequence of SEQ ID NO: 34.

2. The polypeptide of claim 1 consisting of the amino acid sequence of SEQ ID NO: 34.

3. A pharmaceutical composition comprising a polypeptide of claim 1 and one or more pharmaceutically suitable excipients.

4. A method of treating a HER2-expressing cancer in a subject, wherein the cancer is a solid tumor, the method comprising administering to said subject one or more therapeutically effective doses of a pharmaceutical composition of claim 3.

5. A nucleic acid comprising (a) a polynucleotide sequence encoding a polypeptide of claim 1; or (b) a reverse complement of said polynucleotide sequence of (a).

6. An expression vector comprising a polynucleotide sequence of claim 5 and a recombinant regulatory sequence operably linked to said polynucleotide sequence.

7. A host cell, comprising an expression vector of claim 6.

8. The method of claim 4, wherein the HER2-expressing cancer is selected from breast cancer, colorectal cancer, non-small cell lung cancer, and ovarian cancer.

* * * * *